United States Patent 7,745,391 (HUMAN THROMBOSPONDIN POLYPEPTIDE) - sequence listing, part 36

SEQ ID NO: 82113 - DNA, 2496 bp, Homo sapiens
  misc_feature (2496)..(2496): n is a, c, g, or t
aggcaccgcaccgggcagtctccggatctgccgttctgccccggcccggaaaacccggcgccttccaggcccttcgaaagatggattctgttgacgtatctggcggccctggcgagcctggtggaaagttgggttttgccagattgcgccgggctcctctttgtgacgcgcggccagccccgcatcccccccggagccgggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccggtgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcactaaaaagggggggccggtacccaattcggccctattagtgagtcgaataccaattaaattggcccgtcgtttaccacgctggacttgaaaaaacccctgcgtacccacttaaatggccn

SEQ ID NO: 82114 - DNA, 2394 bp, Homo sapiens
  misc_feature (2394)..(2394): n is a, c, g, or t
aggcaccgcaccgggcagtctccggatctgccgttctgccccggcccggaaaacccggcgccttccaggcccttcgaaagatggattctgttgacgtatctggcggccctggcgagcctggtggaaagttgggttttgccagattgcgccgggctcctctttgtgacgcgcggccagccccgcatcccccccggagccgggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctgcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccggtgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcactaaaaagggggggccggtacccaattcggccctattagtgagtcgaataccaattaaattggcccgtcgtttaccacgctggacttgaaaaaacccctgcgtacccacttaaatggccn

SEQ ID NO: 82115 - DNA, 1035 bp, Homo sapiens
aggcaccgcaccgggcagtctccggatctgccgttctgccccggcccggaaaacccggcgccttccaggcccttcgaaagatggattctgttgacgtatctggcggccctggcgagcctggtggaaagttgggttttgccagattgcgccgggctcctctttgtgacgcgcggccagccccgcatcccccccggagccgggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaagggaactcagaccttgggaaaatccagcctgttgcccatccacaggatgtcagtaaggatttcagagagtgaagaaagagaaacaaacaggcttgcacctgcacactggtgggctttggtcttttgggtgtctgcagcagctcgctcttcgactgattatctctatagtggaagctatcttggctgacccctacctcctgggtactcacctccacctatctgtgtgctcacttcgaacccctgcagctctctcctccaagacttcagtactggccctggaagcatgcttagcccaggcacaggacaagcaagaggctctggagcatatgtcaccaggagcagccctcaactgatgatgcaatgtaactggaagacagatgccgctgttttctctccctcagtagggagaaacctgaggttaactcccagtgggacttagccccagttgctcatggcagtcagctgcttattaacgcatcctgaattgtttgccttcctttcctgcctcacttctctattgttccatgggtgctgcctgtggtccccttttacatacactgtatgcactcagatcttggtcacagggtctgcctttgggggaatccaaatttaaccatgctcctccccaaggaaaaatgcttt

SEQ ID NO: 82116 - DNA, 1086 bp, Homo sapiens
  misc_feature (970)..(970): n is a, c, g, or t
aagacagttgaaccttagaagattgagctaagattctttttttggcaacctgcaagtaatgtttcatttttctattacgtgatctctttgcccatacagttggcagatgttttttccccctttttctaccttaaacttttttgtttggagtacagtctaaaccaacatcagttagccttgattttctttcttttttggacaattgtctggttcattgacaaaagtaacaagtttggaactaagagatatgttacaagctgcacttaacaccacctgaaaacccaagaatcatctgaaggttttgtcagtagtaaggtaggttttgtgtgtgtgtgtgtgtgtgtgtgtgtgtgaagatggaatagggtgaaggtgaagaaacagcttgacttgtgcctgttttcagataaaggagtaaagtgatctacaaactgtaactatcttgaaagagaaattgatcatcagatggtcgagtactcttggaatgtctctttgctgtttactgtggcctctttacaatggtgagacttatttctaccctctactttccactattatttttttcccctattggataatactagtctgagcagccctaatactagatgtacctaaacagagatacaagccaagtcattgttcagtgtagtcatttcttagtatctgtttatattttgtcacacatcagaatgtatattttatagagcatgtgtttgtctacttgtttgtctactataatatgtctttaataaagctaaaaacattctgaaaaaaaaaaaaaaaaaaaaaaaaaaaaaaaaaaaaaaactaaaacaaaaacaaacaacaaaacccaaacagcacaaaacagaaaagaccaaaccaacgagaaagggggcggagcacgctacgaacaagccaccccctgaagggggggcaccaacgttaactcacgaacacccccgcgctttacttgagacagaactgaccnagcctgataggggaggccagcgatgacagccggaagcggccgcccggacggagcgacaccgcgggcgcgtcgccaacactagccaagagactgggacgagcccacaactgtggagg

SEQ ID NO: 82117 - DNA, 286 bp, Homo sapiens
ggggaaaattttttaatcaatcaagaagaaacattttatcagaggtacattgtgactgactcagaatgctgaatggtttgctatgtaagtccccattttaatcaatgaaaaccacagaaaaggttcttggggactgaattattaatggctacacaatacttggctaatatggcataataaagtatcatagcaggatttatgtaaaaattattccacaaatttatttactgctgccactatctacttaaaagatgggtataaatttaatcttttcctcatctgaact

SEQ ID NO: 82118 - DNA, 424 bp, Homo sapiens
gaaaaccctgactaacacacctggacagagtgaacgctggcagaaagccgtcttggttcattttcctctgctctgcgggtcctgcacttacctaccctcacgtctgcctgcacagatcctcacccagggtttggaggggacagcctgggacttgtgctcacctccaccactggctggctatgtgagcttggccaagccacctctttcctctttccatgtcctcatctgcagagtggggaaagagcaatgtgcccgtcctccggttgtcctgagcctgccaggacagagtccaggggaacggccatcagtgacctgaacacagcaagggtcaaaaaactggtagctccatttcctgctcctccgtcccctggatccacctccctgtgtcctcctctgggccggggccctgccctcagatacttgc

SEQ ID NO: 82119 - DNA, 962 bp, Homo sapiens
tccctggtgacctaatttccaacatcaaggaaaatgtttcattgcacatttttaaataaactgctgcattttcctgttagctactagatccttttgaaattctcttctctcttaccgtctgtgaaaataatttcttttgatgatatactgaactatctgattagtcttggtctcctctgtgagcccttttgcctctgttaaaagatggttaatctccaaagttctatgtaagttctcctctcttataattctattccctctcactggaagggtagatgaatgcctctgactgtatctacatcagaggatgtatcttttgatctctggagttgcatgtgcaaatgcttctgtacatatctgattgcttacatcacagatctttcacaaccatcatatccaaaactgcacacatcatcttttacctccacccattattgcatactttcattaatggtctcactagctacctaactggtcaagccagaaatcctgtggtcctattgctcctttagtgctactgaaggaattctatctagaatgagaaaactgtgtattttgaagccgaaacaatctggcttaaatacagctcttggactgcttaactggtattctttggcatgtgaaaaacattatttgatcttcaagttcctcttctataaaaatggggcagcagccaggtgcggtggctcatgcctgtaatcccagcactttgggaggctgaagtgggtggattacttgaggtcaggaattcaaaaccagcctggccagcatggtgaaaccccatctctactaaaaatagaaaattagctgggcatggtgacgctatgatgtagtcccagttatgcaggaggctgagtaaggagaatcgcttgaacccaggaggcagaggttgcagtgagccgagattgtgccattgcactttaccctgggcaacaagagtgaaactctgtccaaaaaaaaaa

SEQ ID NO: 82120 - DNA, 414 bp, Homo sapiens
agattccacaaaaaaatctagatttctagcttctctggaaacacaggaatgtgtggtaataagggccaaattttcacatggcaatgatgaactggagctgaattgtcactcctccttttggactaaaccctcagttttcaccactgagcatttaatgctttcttcccttggatcaaatgtaagttgtgtggttcctagatcctatgagcatttgggtttgctaacctgggtgtcatggtaaaatagtaacttgaggtttaacactacctaaagaaaataatattaacaaataattgtatctttacatttaaaataggcaaaataattagttaccagtcatttttattctctataaatgaaatcacatatgaattgtttaaatatgtttacatttaacaaattgtgtttttcatc

SEQ ID NO: 82121 - DNA, 876 bp, Homo sapiens
aaagggcaggctggtacggcccgggagttaggatcgaacatcagagcccgcagctctcggccctgctggtggcagaggctttgtactgtgtgacaatgacctggatatggaagcagaagggagcttctaaggaccggaagctgagagtctgtctcctgtcccggcccggacactggggttcaggaaccagagcctcagtgtctgcaggagttgctggctgtttcctgatgcagttggagcagaatgggatgtcctgggacaacagagatgtttacccatcttgactagtgtggtcatctgaagaatggcctccaaagacatcctgagaacctgggaatgttgcatggatgaaggaatttgcaaaagtgattaagttaaggagcttgaaatttgtggatcatgctgggttaccccagtgagctctaaatgtaatcacatgtgtctttatgaaagggaggcagagggagatttgcagacagatgaggaggaagatgagaaaacaatggacacaagaaagaaaaggtgatgcagttcagggacccaagccaataaatgaggtgacctccagatgctggagaagggaaggaagcagatggactctagagcccccaaaagaagcagggctctgccatcaccttgattttgtcccaatgaaacccattggtcatttagctgccagaactgtgtaagcataaatgtgtgttcgtttaagccatgaaatttgcagtaatttgttaaagctgccatgggaaactaacacaactggagtggtagttccgtgaatgcatgcattcaccaaaccttaacatgtactcttcggatactggcatgataggtccatgaatgcatatgttcacccacacactaatatatacc

SEQ ID NO: 82122 - DNA, 534 bp, Homo sapiens
gtccatttaccctgatgtgattattatgtactgtatgcctatatcaaaatatctcaaatacctcataaatatatatacctactatggacccataaaaaaaaaaaaaaaaaaaagaatatactaaaggtatatcaggctgttatttctaattcctaatacacactttatttttttttcagagggtctcactcggtcactcaggctggagtgcagtggcattatcatagctcactgtagcctctaacacctgggctcaagggatcctcctacctcagcctcttgaatagctaagactacaggcatttaccaacattcctggatcttttttttttttttttttttggagaggcagggtctcgctctgttgcccaggctgatcttaaactcgtggcctaaagcgatcctcccacttcccaaagtgctgggattgcaggtgtcagccaccaagcccagctcaaatacatattttaataagctttactaacactaagtgacataaatgggcaattctttctgataacctactggtagggc

SEQ ID NO: 82123 - DNA, 257 bp, Homo sapiens
ttttttccacaagtatttttgatctgcagttgttgaatgcacagaagctgaacctgaaaatatggagggccaactgtacctaatataaataacacatttttaaaaagaaacttattttcctttaaaaaaaattagtgagtgagggcaagcgtggttgctcatgcctataatcctagcactttgcggggctgaggcaggaggaccacttgagcccaggagtttcagaccagcctgagcaacatagccttcttttattt

SEQ ID NO: 82124 - DNA, 509 bp, Homo sapiens
ggtagttctacttttaattttttaaggaaactccatactgttttccataatggtcttgctaatttatattcctaccaacagtgtataagggtgcccttttctccacttccttgtcaacacttgttatcttttatctttttgttaataaccattctaactggaatgaagttgtatttcattgtgattttgacttgcatttccctggtgattagtgatgtggagcattttttcacacacctgttggccaattgtatatcttcttttgagaaatgtcatttcagatcttttgcccattttttaatctttcttttcttgctatagagttttttcagctttttatatatcttatagatcctagatattaaccccttttggatatggaaatatagtttacaagtattttcttgcattctgtaggttgtatcttcacctgttgattgctttctttgctgtgcagaagttttttactttgttataatcccatttattttgtttttattgcctgtctg

SEQ ID NO: 82125 - DNA, 306 bp, Homo sapiens
cgcacacatgtggctctgaagggaaggacccattccttgaagtcagttcacccacagcctctgtgatgccttccctcatcttccaacttctgcatgcccgtagctctctagttacatcctggacactgggattaggtcatctgccttgattactcccagtcccattagactagatgcctgtagaaggcagggtcctggcaaaatatcaatgtattcaattgcttttatttttttgagacagacttgccctgtcccccaagctagagtgcagtggtgagatcatagctcaccacagcctccatatcc

SEQ ID NO: 82126 - DNA, 454 bp, Homo sapiens
tccctgcaggcccctgctgccttagcactcccatccccaccagccacagtagctcacccacatgggccaaggtgggtcaagtcaacgaggtcaaggcctcatctcccagagggttcccaggaaaggggcctaaagggccttataatcacctaccagacatctccatctttagggcgcatcagagcaggtgagagaatttgtaagctatggtgagtcaagagtgatcacaaaaaactcaaattcttattcttctcataagttctatcacttgtctctttggagctttctacctctaggcaaaaaggagtgaagtctcaacaatgtaatgggttggaccaaactactgagtactcattacatactgagcccaccagtatgggcaccagccagggagtaaatggcaccatttactccatggcctgtggcctctccttttaggtctaacaatggacag

SEQ ID NO: 82127 - DNA, 233 bp, Homo sapiens
gtgtatatctggtgtctccccaaggagaatgtaagctccttaatgatagattgcttacacttctgtgttatcttccctcagtggtaataatggatgttcattcaatagatatttattaagaatgatggctgggtgtagtggttcacgcctgtaatcccagcactttgggaggccaaggtgggaggattgcttgagtccaggagttcaagaacagcctgggcaacatggcgaaa

SEQ ID NO: 82128 - DNA, 557 bp, Homo sapiens
tttgattttgcatgtgctaatcacccgaagacagtaacattaaaaaaaaaaaaaaacaaaaaacccaagcttaagaaagtcaaatagtacaggttactgaaaaagtataggaaaaattgatgtttggtactgttgcggatactgtgtccatattatggtaatatatgccttttcttatgtgagtaatacacagtttagcattcacaattttattaccttatcaatgtagtttacatgtttctgcgagtatcacaattaaagcagtcacagtttttaaagctatattcatgaatttaatctttttcactttcctgtaagacagagtcaagtagacctttaaaagtaatcagtttgcattcaggtactttaagacttgctttaaatcaggtaattttttttcatgtagacataccaatcaattttcattaattgacttgtaaactatcatcagaatgaaatactgtgataactaaagttttcagttatcaagtttgtgttaagtgaagttcttacctcttgcttcagtctttagacttgtcctacatattccttgtaaa

SEQ ID NO: 82129 - DNA, 781 bp, Homo sapiens
  misc_feature (766)..(766): n is a, c, g, or t
ttgagatggagtttctcttttgttgcccaggctggagtgcaatggcgtgatctcggctcactgaaacctccgcctcttgggttcaagctattcttctgcctcggcctcccaagtagctgagattacaggcatgtgccaccatgcccagctagctttgtatttttagaagagatggggtttcactacgttggtcaggctgctcttgaactcctgacctcaggtgctccacccacctcggccttccagagtgctgggattacaggtgtgaaccaccgcgcctggctggaattttcttccttctcaatttgtttgcagtgtggctaggcagatgagataatagatagtctctgtttcagtttttctccaattgtataccctaaggtccttgctaaataaatccagctttgaattaattatcctgtccttccttggcttcccatctttactgtcataaaatactacctgttggctcgagctgctgggtgggtggtcatacatctcttctttcctaggtctgaaggtaactgtggtgttaattatgaaagtactgtcaattgccgaaagtgccccatgctttcccctccccacctttccctcttgttttacaacagtggttgtggggtgaacacaaggagtgtagtctgctttacaagatgtttagtcaatagttgtagacaaatgtaaataacagcaggtgatcaactatgggacaaatgcataggagagaaattgcagaaattgtgtaacttttattttgatcctgtanttttaagcacagctt

SEQ ID NO: 82130 - DNA, 527 bp, Homo sapiens
ttccgcaccatggtagctgtgttcttttactctttgcaataaatcttgctgctgctcactgtttgtatccacactgtctttgtgagctgtaacactcactgcaaaggtctgcagcttcgccaagccagcgagaccacaaacccactagcaggtagaaactctgaacacatctgaacatcagaaggaacaaacttcggacacgccggcctttaagaactctaacactcaccatgagggtctgcaacttcattcttgaagtcagtgagaccgagaacccaccagttccggacacaatgagacttattcactatcatgagaatagcatgggaaagaccagccccatgattcaattacctcccactgggtccctcccacaacacgtaggaattcaggaagacacaattcaagttgagatttaggtggagacacaggcaaaccatatcagtgagtttcattatattttcgtatttaatggctatttgcatgtctgtttctataaattgctggtacattcttttttgccgtaa

SEQ ID NO: 82131 - DNA, 408 bp, Homo sapiens
aagtgctttgagcattgtgttttttttaaaagataactagactttcaagagatttcactctcgcctggggctgcttccgggtatattctcagacttaccagctctccctgccagtccaaccacactcccactcccacgcccaccatgagttcattctggcctaaaattaggagtatttctgtagaggagtgtgaaatgtaaaaagctagatattattatatagaaatattcaattgcatttaaaatttattagcagtagttaccaataggattatcaataaacaagaaagcagcaactctggagtcctgccatgccaggcatatcctagactagaggaattcactatttagaaagacttgaaagtcctaagtgccacaaagattagtttcattgggactaaaaaaaaa

SEQ ID NO: 82132 - DNA, 331 bp, Homo sapiens
ctgagtaggggacactgtaaacaattatctgaaggaatacataaactataaataaaaaaaatacaggggagcttagtaggagcaatctcattaaagtggcatagacagaactatactgccaaaggctatgaagtgaacagaaatccaagtagaggccagagaacacatttaagaagtttagaagaaacagaaaaagaaacagaggaccctagacttgaagaggcacaattaaaagatggttgcttaagatctcagatacttgggcatgttaaaaagctgaaggaaaaagagtcaatgttgtacacaataaatatatataattttacctgtc

SEQ ID NO: 82133 - DNA, 484 bp, Homo sapiens
tggggttcttgtcctaacctgacagatcagaaaactgaagtccttccaaaatggatgacttaccttacctaagatcactaagaattgaacgagtgagaggatgagggtctaagtcttcctgctcaggggctggttgaagaatcagagagaagaaagggggcctcgtagacccacacacagcatgagcaatggtataacatggtgtcaggggaaccttgcatggtttggagaagagccccagtgtgaaaggacccagcactgtgcctcgtacatggcagatgctcagaaaactacccttccccttctttcagccgcaagaaccactgcttcggtttcccacactgcctggccaccatcatgccaccttctaggttaaggggtgtttgggcagatacttggttttggtaggggtgtgagagaagggagacaggttgtcttgtgctccttacccaagtcgggatccatctttcctagctctgattgt

SEQ ID NO: 82134 - DNA, 685 bp, Homo sapiens
agctttctcaacaataattttgactaagattccctttggttactgccacctagaactgatttaacatccctgaactagaggatgagtcccccccaccgcttgaacttatataaaggttgagaaatttctgaaagttttttttatgaccaatgcaagtctgcatatagtgtgaattctcacttgggtattttggattttagaactgaaacttcaaatttgtatgtcaaaacatttacagaaatgttcaaggttttcagttattcttgaataaatgttcctaactaatacccagataaagcctttgtggggaaatgataatctaaatatctggatacttctaactttactttgccagttaaggtttgttaagaaaattaaacatctactatcactaacatttcatataagaaatgaacaagggctgggcacggtggctcacgcctgtaatcccagcactttgggaggctgaggcgggcaggacacgaggtcaggagatcgagaccgtcctggctaacgtggtgaaaccccgtttctactaaaaatacaaaaattagccaggcgtggtggcgggcgcctgtagtcccagctactctggaggctgaggcaggagaatggcatgaacctgggaggcggagcttgcagtgagctgagatcgctactgcaacagcgagactccatctcaaaa

SEQ ID NO: 82135 - DNA, 368 bp, Homo sapiens
tcctgtatccttgtactgctccatgacattgacatgtgatgtgttttatttctgcccgactctttactgaaccctttctacgctcactgaaacctggagtaggtgatggctttgagtaggaaatgactttgtgagtttcttccgtaaaaggcatgtgacagtacagggtcagaaggtggagtgatgcagtaacctgtgtggcaaagttttcaagcatttaaaaatatatgtgaaagccctaaacatagtacttagaccacagaagacaatcagtagatgttaggcttttctcccactcagaatacaaacaaatatattttgatacactatccagtttctaacctcaggtggtctttcaaaaccgaagt

SEQ ID NO: 82136 - DNA, 889 bp, Homo sapiens
cacctggagagtcggggcggcacgttgagaccccaggggtgaagggcgggggatcccaatcccagccctgttttcccctcccctttcacggtgaacactcatgatacatgtgttccaccattggttggaaaaggtgactaggaagttgtccttaggcattataattataagacgtcatttagtagaatagcaagatgagttgacaaggaggatgagttgcgctaggacgtgctaagcgttgttgtagctacgaaagggggaatactactgtagagagtggtcgactcgacagaaaataacattaaaaaaatgtatataaaaaaataaatttggaaaaaagaacacacggccacagtgatagccaaataccaaaaatgaacagatacagcactatacgcaaccaaaccaacaccatggactactaagacaacaaaacaaaaaatacgacgaaaggaagaaactgaagctacaagagaaataacatccaaacgaacgacaacactgaacacacagaaaacccacaggcgaacacagagacgcgacaaacggacacaacaaagacagaacggccaactggcaaggcgacaaacgagacacaaaaaaaagcaaaaaggaataaacgaggaaacactaaatgccctgaagctaggaatgcaacaggcagtaaccaaccacagagcacgcaaaacacccagggatcgaacaaaaataagcaacaagacggaacgatgacagcagaacacaagagatcagaaaatcaacaaacacatagaagaaacaggcgccacgaaccacaacaacaatacacaaaacgataagtagaagaatgacaaaatagagacggagcaagacatcaccaacgaacacagacaataagaagaagagaaag

SEQ ID NO: 82137 - DNA, 1011 bp, Homo sapiens
acctcagcctcccaaagtgctgggattacaggcatgagccaccgtgcccggccttctttacatttttattgctcacagtcaaacattcctattgattgtaaaataagcaaacctagagttgtggagatttatatgtatttatttatttgaattgagacagggtcttaaactcccaggctcaagtgatcctcctgcctcaacctcccaaagtgctgggattacaggcatgagctagctggcctgttgacttttttttttaactctaacaatttctgttttatagtgaacataatagtataagacttagtttatatatttgacttacaaataaatcctggggagaggggagtatgtgtaaaacataattcagagcagccttctttgagaaagtgggtgtgtttggctgtgtaacaaaacaataaggggatgtgtttgctgtgtaacaaaacaatgaaggatttaagcaggatatttttgcctcatatgttaaatccaagtgaggttgctgtggtggttggtttagctctcagtgatgccttttttgtatttttccgctctgctgtccatgacatatttctaacacctttatgattattgttcctgcttgtaaaagggctgatatttacatgagtgcaaggcaggaagaaaaggtagctgtgccagccacttctggcaagcagttctcccaccttagcctcccaagtagctgagaccataggcatgagatttctcaaaattcctcccagcaggctttcacttagtttcattgttgagaactgtgacaggtccatctctagctgcaaaggaggctgagaaagtgaacacagcagtcctccttatccttggggaatacattccaagagtggatccctgaaacagcagatagtactgaaccctatatatactatgtttttgcctatgtatatatacttgatatggtttggctgctacccaacccaaaatctcatcttgaattataatccccaaatccctatgtgttaagggtgggac

SEQ ID NO: 82138 - DNA, 579 bp, Homo sapiens
acctcagcctcccaaagtgctgggattacaggcatgagccaccgtgcccggccttctttacatttttattgctcacagtcaaacattcctattgattgtaaaataagcaaacctagagttgtggagatttatatgtatttatttatttgaattgagacagggtcttaaactcccaggctcaagtgatcctcctgcctcaacctcccaaagtgctgggattacaggcatgagccactgcacccaaccagttagttatttttcataggctcatcttttagtctttctagtcaagatgtgagtagtttacacatcacagttacagtgttacaacattgtgttgttctgtgtgcttactgttaccactgagttttatccttttagatgatttcttattgctcctcagcatccttatttttcagattgaagaaccctctttaacatttaactttagggatgactgattgttgttgaaagttttgttttccaaccagtttttgtaattacgtacttctctgggtcccttttgtagttagacttggatgtgatgatatgcttcctctaacatgttcctttcccggg

SEQ ID NO: 82139 - DNA, 499 bp, Homo sapiens
gtgaaaacagggaagtagatgcccagagagagaatggagaacaaacagagaaggaagccaagaacaacctccaaggaaaacacaacattcaaggtacacgtaaaagaatagaagccagtaaagtagagaaagaaggacaaatcagagaggagaagagccatgagatacctctcagaagccatggtattaaacatctccagtgccccagttaagtcaaataaggtgggaagtggaaactgacgaagtttattggacttggcgctttcgaagtcactggaaattaccaccacagcaatttcagtagattagcaaggtgttgactagagtaccattaagagtgattgaaaggtaaagagatgaagacaacaaacaaaggctattcttctaagaaatttatcatgaagataagaagaaaagcaatgaaatgcagatcgacatcttcattttggacatctagtctctagaactctggaacaataaattcctgttgattataaaa

SEQ ID NO: 82140 - DNA, 1032 bp, Homo sapiens
ccttcatttctccagcactaaaatggagtggagagttggggtggaaataagacatccttaaaaggttaaattgtctgcaaagcacctagcccagtgccgagctcccagtaggtgttcagtaaagcttagtgcctgactttctgaacactgattcctcctgtttggagtcactgggatactctcattgccgttgggatgttcctcactccttcccagttcgtggctgaggcagaacccagactgaagagggaagagacattccagaggaggattgccttcgtcagggtaaggggtgggctgctcaggggccctacccttcacccccttctgtatcagattggccctcccactcccatctcactctgcgtgtacaatcttccatatccgcaagttcactggcactcttctggcacctgggcaagatcccagaacagaggatggagtgactggcctcacagagcttagtgcccgactcaggggaaatgggactggtgcatgggaaatggtcagcctaggataggacacgagagtctgaaattcaaagcaaccagcttgaagtggtttgagaagctggaagcaaacatgggctagagagatagggcagaagtcaagacgaggatctggactgatgtggagaaagtagccacggaagcatgaactgtatcctgcacaaagtccctcttccccgcctcctaattcattatgcccaaaaggccttacgtgaaattccagcccagagtactcatgacttgagagacgtggacagagccagcttctaccttgcctggccgtctctcccctgtcttaatgtctgctcttgctctaagctccagaagagtggcgggccatgtatcttcaatatgtttttgctgtatgggcaggttgtcttattatgtgatcaacagatgtccaggaactaatgagtggaatttaatattattgtcaaataaaacttgatttgtcctatatttaatgaccagtagttactttgctgcatgaccctgctagttggacagtttatataaatcattt

SEQ ID NO: 82141 - DNA, 3381 bp, Homo sapiens
gctgcggctcgccgcgcggctccagctggggcgcggtggtcccgacggtcacccgaatcgcagggagtcgccgctggagaggggctcggcgcccggcggggactgcaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtgccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaactctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcacacacacacgcacacacctcaataatttctctcaagtttcctgagttccagaagagtggcgggccatgtatcttcaatatgtttttgctgtatgggcaggttgtcttattatgtgatcaacagatgtccaggaactaatgagtggaatttaatattattgtcaaataaaacttgatttgtcctatatttaatgaccagtagttactttgctgcatgaccctgctagttggacagtttatataaatcattt

SEQ ID NO: 82142 - DNA, 384 bp, Homo sapiens
tgttggaggtggaggtggggatatgactcgtgaggtgtaaaaggacgcatagaagcaaactgctaggcaccctggagggtccacagaacagcttctctgcaggttcgcctgagctccatccgggaatttccaacctgattgtccagtgcttggctccccacgaggcacacggacgatgctgaaggaactgatcagcccatgaactcttttcttcttgacccacagggatctcctaccagagactggtgagggctgagcagggcctgcccatcaggagtcaccgcagctccaccgtgtgagtgctcttgggggacggagaaacagtggggagggagtttgggacccctgcactgttccaccttcaccctcctcccccactcaaac

SEQ ID NO: 82143 - DNA, 3502 bp, Homo sapiens
aagcttactcagcgcatctgctacagcattttatcttcccaagagccccatgaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtcaccgtgctgctgctgaacccagtggaagtgcaggccgagttccttgctgtagccaataagctgagtacgcccggacactcgcctcacagtgcctacaccaccctgctcctgcacgccttccaggccacctttggggcccactgtgacgtcccgggcctgcactgcaggctacaggccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaactctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcacacacacacgcacacacctcaataatttctctcaagtttcctgagttccagaagagtggcgggccatgtatcttcaatatgtttttgctgtatgggcaggttgtcttattatgtgatcaacagatgtccaggaactaatgagtggaatttaatattattgtcaaataaaacttgatttgtcctatatttaatgaccagtagttactttgctgcatgaccctgctagttggacagtttatataaatcattt

SEQ ID NO: 82144 - DNA, 3215 bp, Homo sapiens
aattaagttcaattttgaaaagatctttgaaaacaacagctgaaaaatgctcagcagtgaaccccacgctttcccctggaaacctggaccctggagctgttgcttctgtcctggcctcctgtggtcacctcctcgagctctgcctgggcttgaggaggccctggtctcagtggagctgagcaccagcaggcacgaggggggtggctgcactgtggcatgctgcgcacccctgggtgccatagccggtcccctgtgtccccagcaccgtgctgctgctgaacccagtggaagtgcaggccgagttccttgctgtagccaataagctgagtacgcccggacactcgcctcacagtgcctacaccaccctgctcctgcacgccttccaggccacctttggggcccactgtgacgtcccgggcctgcactgcaggctacaggccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaactctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcacacacacacgcacacacctcaataatttctctcaagtttcctgagttccagaagagtggcgggccatgtatcttcaatatgtttttgctgtatgggcaggttgtcttattatgtgatcaacagatgtccaggaactaatgagtggaatttaatattattgtcaaataaaacttgatttgtcctatatttaatgaccagtagttactttgctgcatgaccctgctagttggacagtttatataaatcattt

SEQ ID NO: 82145 - DNA, 375 bp, Homo sapiens
tgcagtgtttgttaacttgttcctgtctacttgttgcctgtgaactggaagttaaatctaaagccttgattaggccaagcatggtggctcacggctgtaatcccagcactttgggaggccgagccaggtggattggcctgaggtcaggagttcgagaccaacctggccaacatggtgaaaccccatctctactaaaaatgcttggctaatttcttttcatttatatttttttttgtagagatggggtcttgctatgttgcccaggctggtcttgaactcctggtctaaagagagcctctcaccttggcctctcaaagtctcaaaagtgctgggattacaggtgtcagccactgcacctggcccccgtcctgcatt

SEQ ID NO: 82146 - DNA, 425 bp, Homo sapiens
gtgtccaaattagcataggcttgtaagagtgtaaacaaatgatatggccaaaagagtaccggacatgggatcagaagacctggtccagcctagctgtactccttactgcttgtgtggctctggataggacactcctgagcttccacctcactttcctacattgtgagcacaaacacacctacctggaagaattgtaagggctgagtaggttcatgtgtatcattgtacccagcataggaagctttttataagtagttgaaataattgattggtgaagtgaacatagagaattctgtctcttatccttcttgtccctgggagtagaaagcctgcttttggtagatacctaaggcagaaatagttctggggaagtggggagaaacagggtggggcagtgcgtttctcactttgcagatcttcctggg

SEQ ID NO: 82147 - DNA, 471 bp, Homo sapiens
cacctcccacctgccacaggtgtgggtagagtggactgctgaggtcatggacaaaagcctgcaggcaaaaagaagaagatattggcagttagaagtggctctgagcctgctggagggttccagggctatgtggagggcacgaacagcatctgctcccctggggatgatgacaggtgacactgggtgactcagatcttcttgccataacatggagacacatggttagaaagccagtccattgtctcaaggagaagagtcccagtttggtgctaataatcttaacacctttccaacactgttcatctccatctggaaccaagaaagagccagccttgggcctagtgtctttggtaggccgtcgtatgtacctacctgcaattgatgatgttgctttggtttctacttaatgttttccaataaacttaagcatataaagtttgctgttgaaataaatttatatagttaaaaaat

SEQ ID NO: 82148 - DNA, 1023 bp, Homo sapiens
aaaaataaaaagaatgaattataccaggtatttgatagaacaaggtgactaccgtcaaaacaatttaattgtgcattttaaaataactaaaagagtataattgggctgtttgtaacacaaacgaataacacttgaggggatggatacctaattttctgtgataggatcatgcattttatgtctgtatcaaaatatctcatgtacctcgtagtatacctactatatacccagaaaaattaaaaattaaaaactaaagaaagaaataattgcaaaatgtaataatgtctttgaggggaaaataaaaacttcagtgaaatactctaagaggggtttgatgcagagctgggggatgtgggaaagtagagataggaaagttgaggagggagggatgggttacagtttgccaaggacagaattacttgagagggtgggagcaggacacacatgtcagggcctctggaacaggaagaggttggtttatggcagaaattgaaagaatgctctcatacacagctcactttcctccttgctttttgtctgcatagcattattcaatatgtagcataatataagttgaaatcatatatcacctttgtggtcttctcccaccagaaatcaggcattatgaaggcagaagggcagaggtatttgtcgtgtgtgtgtgtgtgtgtgtgtgtgtgtgtgtgtgtgtgtgtgtttgacttttgtatttttgctgccgtattcctggtacctggaatagcacttggcagacaaatgtatgcaaagttattcaaatccagtgggaccagaccacagtgaggacagtcaacaagggagggcagggaatgagcgctgtcagggagggtggagtccaggtcactggggttgctgtaagcatgttctgaatttatatgttatccaaagtataatagaaaacactgcattaaaccagacatgtcatatagttaccatcttttctttttctaaaagagaattattgcaatttatttccttattaagtcaatttagattaggttgcac

SEQ ID NO: 82149 - DNA, 341 bp, Homo sapiens
tctggatgaattaacacttgagttagtaatctgaataaagcaaattgccctccctaatgtggacgggccccatccaatcagctgaaggcctgaaaaaaaaacataaaagctgaccctcttgcaagtcagaaggaattcctcctacctgctgccttcacgttgagacatcggtttttcctgtttccagactctgctatagactgaatgttggtatcccccaaaactcatatgctgaagccctagcccataatgtgatggtctttggaggtggggcctttgagaggttattaaatgagatcatgaggatggggcccccgtgatgggaatagaacactattccc

SEQ ID NO: 82150 - DNA, 866 bp, Homo sapiens
aactgtcgcggccgccgccaacatggccgagaccagcgaggaggtggcggtgctggtgcagcgggttgtgaaggacatcactaacgccttcaggaggaacccacacatagatgaaattggcctgatcccatgtcctgaagctaggtataaccggagtcccatagtcctggttgaaaacaaactgggtgtggagagctggtgtgtcaagttccttttaccatatgtccacaacaagctccttttgtacagaacaagaaagcaatggctgaacagagatgaattgatagatgtcacatgtaccctgctgcttctaaacccagactttaccactgcatggaacgtgaggtatgtcattttcattagtgatatgataaagtttgtccaaatttctgaagacatgtaagccccataagttgttagcttttgaaaacgaaatataaaccattttacacttatttcttctccctattctttatacctgtgacaattctaaataggcattttgcccctttttgtgtggtgtcttcataaactttcttgcctgaaatataaattgtcatgttgagttacagtatactgtttgatacatgcttttattttccttcattttttggggtgggagactaatgggcaatgggcataactggttggcttataaggcatataacattatatcattggtatttgagaagcactgcagtgtagtggaaagtgtatgggatgagaaagagggagtcatgcttgcctctggctttttccctgagcaactgaaaggatggaattgccatttactgaaatggcagtgtctggaagagaaacagatttaggtaggcggtgtttgttataggccaagagttcagattggg

SEQ ID NO: 82151 - DNA, 2752 bp, Homo sapiens
gtaatgtctgctttcttatatttgcccttttgtaagtggtctgtttcttcttttcatatactttgttttgccaatccattacgtattttttgtcacttttgtgtgtcatttttgtatacctttcctttcttacttcaggggtgtgtcttcaagatttctaccccctatttgcaatgaatttcatacctcatctaaaatacattcatataccagaaatatgaagagtggcccttctaaaagtttccctaatgatggaagctgtcagttgtcctatctgtgcagaatgtgagtaatagtggcagaaataagtgtgacaacaatgctttgcctgttgttctttttacttgctaggtaatttgtaaagtggggataaagatgtagggaaagtaaacctctctctcactgttacggaaagcctggacttgagttaggtagactgccttaaagaagaagaaatatgtccttttctttggcatcatggttttgttgagtggcagactgttgaagtgagttgagacttaagaacgccagaaaagttgtctagcctggccccagtagacagaatttgttcttctctcaagtaaaaaattacctttttatagcttttatattatttagatgaaaaaataccattatgaacataattccatggccctttgtgtacaaagcatattttgaattaaatacctcaaggtccacctagactctatgggtaaaatcataagtttatgatttttagctcctgtgagtgtttgggggcaaactacacagagaagacatgggtggttcagcccattccactaaaatatgttgccagattctggcctaactcagtattaccttttttcctaaaaatcatttttcacattttgagtaatagggcttatgctttgatgtgaaaaaatgtcaggaaatgagtgtagacaataccctataaaacactagctaagttttatagtgctccatgcctttgtgtaccttccactgattatcttgcctatctttggtgtgtaaactattttcatatcttctaaggctcttaacccactcttttctgaagccgcacagtcctttaatatgtcttgtttccttcctaaaagtttaaagtagagagcaaaaatgcaaatacccaaaggatactgttagtatgtaacttttgtgtgctgctttatttctagagtttgcattttttaattgttcattcacagaaaatcctaatattgccctatatggttggtttttttcctaagtggttaatatttaaacccgctagctgtagcatgataatgtctttgactgagcttatgtagtagaaaggatgtgtctgttttctgggacttttagtcttcacttatttttctataacaatctaattgttaaaaggaaaagatggcttattgacacatatttcattaaactttcactggaagaacagtgggtcatcctactgtggattaagaatactactgacaagcaaaaagcattaagctctgtaactgtctccaacaccaccttcaccccgcctttagtgtaccttagtgtactttagtgtacctattttggcagtacggtgttttccagattctacttgtgccctgcacattgtgaggactcattaaatatttattaaattaatgaatgactaacaggaagagaaagattgtttgtgagtgttaagaatgagtgatgattgagaaattgatggattagtgcaatggattgggaatgaatgatgctttctagtttcgtaatacttgggaagagctattgcatatagagtaagttgatttagactttttttttcttcatttcattaccttgtttaaacttgttaaatcccagccaagaaatgcagctctgtaattgtcaattaactgtattataatatatattaaaaatttgtagagctaaagaacccacttgcattaagaacaccactttctgttcatttgtgatactagaggacagatcctgcatacagagccgaaactgcttttaatcatctgaagaaattctttgatttcagtgacttactgatctgtacctgtgcacatatcattttatgcttctccttttttccccgcaacttgaactgtgactctttcagatatttcttaaatctgtatgagtcattttttaagcttagggatttgatatgtattaatgtcccctttgtcttctgtagattttagcattttattacctcttaagaaactctgggcccagactttcagtcatatttcttattcctatggtacagttctcacttaaaggcttaattattagtagggttaaatatatacaggttatctctaaaagtacttaaatttttaaataagggcttatgtgatacaagatacggaaacaaaagtttttggatttttatgcagtagtttgcaggaaagcaaatacatagtagatcgtatgccacttaggtatgttcaggtcatgccagtttattcttgttgggccacacacacatgtatgtgtgtgtaaaaggaatttttagtattgaagcaaacaaattgtcagtttaataattttctcttacatagcacaagatggcagataccacctactgtacaacaatctaataatccctaccttagttcccctgagttatagaagatgctaaagatttagttgtaaagggaagtaacatgattttttttttctaaaaagctgttttaagctaactattattttgctactggaaaattatattttaaaacttacagatatttaaagtatg

SEQ ID NO: 82152 - DNA, 2697 bp, Homo sapiens
gtaatgtctgctttcttatatttgcccttttgtaagtggtctgtttcttcttttcatatactttgttttgccaatccattacgtattttttgtcacttttgtgtgtcatttttgtatacctttcctttcttacttcaggggtgtgtcttcaagatttctaccccctatttgcaatgaatttcatacctcatctaaaatacattcatataccagaaatatgaagagtggcccttctaaaagtttccctaatgatggaagctgtcagttgtcctatctgtgcagaatgtgagtaatagtggcagaaataagtgtgacaacaatgctttgcctgttgttctttttacttgctaggtaatttgtaaagtggggataaagatgtagggaaagtaaacctctctctcactgttacggaaagcctggacttgagttaggtagactgccttaaagaagaagaaatatgtccttttctttggcatcatggttttgttgagtggcagactgttgaagtgagttgagacttaagaacgccagaaaagttgtctagcctggccccagtagacagaatttgttcttctctcaagtaaaaaattacctttttatagcttttatattatttagatgaaaaaataccattatgaacataattccatggccctttgtgtacaaagcatattttgaattaaatacctcaaggtccacctagactctatgggtaaaatcataagtttatgatttttagctcctgtgagtgtttgggggcaaactacacagagaagacatgggtggttcagcccattccactaaaatatgttgccagattctggcctaactcagtattaccttttttcctaaaaatcatttttcacattttgagtaatagggcttatgctttgatgtgaaaaaatgtcaggaaatgagtgtagacaataccctataaaacactagctaagttttatagtgctccatgcctttgtgtaccttccactgattatcttgcctatctttggtgtgtaaactattttcatatcttctaaggctcttaacccactcttttctgaagccgcacagtcctttaatatgtcttgtttccttcctaaaagtttaaagtagagagcaaaaatgcaaatacccaaaggatactgttagtatgtaacttttgtgtgctgctttatttctagagtttgcattttttaattgttcattcacagaaaatcctaatattgccctatatggttggtttttttcctaagtggttaatatttaaacccgctagctgtagcatgataatgtctttgactgagcttatgtagtagaaaggatgtgtctgttttctgggacttttagtcttcacttatttttctataacaatctaattgttaaaaggaaaagatggcttattgacacatatttcattaaactttcactggaagaacagtgggtcatcctactgtggattaagaatactactgacaagcaaaaagcattaagctctgtaactgtctccaacaccaccttcaccccgcctttagtgtaccttagtgtactttagtgtacctattttggcagtacggtgttttccagattctacttgtgccctgcacattgtgaggactcattaaatatttattatgatgattgagaaattgatggattagtgcaatggattgggaatgaatgatgctttctagtttcgtaatacttgggaagagctattgcatatagagtaagttgatttagactttttttttcttcatttcattaccttgtttaaacttgttaaatcccagccaagaaatgcagctctgtaattgtcaattaactgtattataatatatattaaaaatttgtagagctaaagaacccacttgcattaagaacaccactttctgttcatttgtgatactagaggacagatcctgcatacagagccgaaactgcttttaatcatctgaagaaattctttgatttcagtgacttactgatctgtacctgtgcacatatcattttatgcttctccttttttccccgcaacttgaactgtgactctttcagatatttcttaaatctgtatgagtcattttttaagcttagggatttgatatgtattaatgtcccctttgtcttctgtagattttagcattttattacctcttaagaaactctgggcccagactttcagtcatatttcttattcctatggtacagttctcacttaaaggcttaattattagtagggttaaatatatacaggttatctctaaaagtacttaaatttttaaataagggcttatgtgatacaagatacggaaacaaaagtttttggatttttatgcagtagtttgcaggaaagcaaatacatagtagatcgtatgccacttaggtatgttcaggtcatgccagtttattcttgttgggccacacacacatgtatgtgtgtgtaaaaggaatttttagtattgaagcaaacaaattgtcagtttaataattttctcttacatagcacaagatggcagataccacctactgtacaacaatctaataatccctaccttagttcccctgagttatagaagatgctaaagatttagttgtaaagggaagtaacatgattttttttttctaaaaagctgttttaagctaactattattttgctactggaaaattatattttaaaacttacagatatttaaagtatg

SEQ ID NO: 82153 - DNA, 1394 bp, Homo sapiens
gtctttgattagccaaactgtgatagacagttctgtgatggagcaaaatcctttgagaagtgagccagccctagttcctccaaaagatgaagaagcagcagtttcaacagaagaaccaaggattaatcttccccatcttctagaagaagaagttgaattcagcactgatcttattgattcctacccaggacatgaaaccctttggtgtcataggtaagaaaagattctacttgtgccctgcacattgtgaggactcattaaatatttattaaattaatgaatgactaacaggaagagaaagattgtttgtgagtgttaagaatgagtgatgattgagaaattgatggattagtgcaatggattgggaatgaatgatgctttctagtttcgtaatacttgggaagagctattgcatatagagtaagttgatttagactttttttttcttcatttcattaccttgtttaaacttgttaaatcccagccaagaaatgcagctctgtaattgtcaattaactgtattataatatatattaaaaatttgtagagctaaagaacccacttgcattaagaacaccactttctgttcatttgtgatactagaggacagatcctgcatacagagccgaaactgcttttaatcatctgaagaaattctttgatttcagtgacttactgatctgtacctgtgcacatatcattttatgcttctccttttttccccgcaacttgaactgtgactctttcagatatttcttaaatctgtatgagtcattttttaagcttagggatttgatatgtattaatgtcccctttgtcttctgtagattttagcattttattacctcttaagaaactctgggcccagactttcagtcatatttcttattcctatggtacagttctcacttaaaggcttaattattagtagggttaaatatatacaggttatctctaaaagtacttaaatttttaaataagggcttatgtgatacaagatacggaaacaaaagtttttggatttttatgcagtagtttgcaggaaagcaaatacatagtagatcgtatgccacttaggtatgttcaggtcatgccagtttattcttgttgggccacacacacatgtatgtgtgtgtaaaaggaatttttagtattgaagcaaacaaattgtcagtttaataattttctcttacatagcacaagatggcagataccacctactgtacaacaatctaataatccctaccttagttcccctgagttatagaagatgctaaagatttagttgtaaagggaagtaacatgattttttttttctaaaaagctgttttaagctaactattattttgctactggaaaattatattttaaaacttacagatatttaaagtatg

SEQ ID NO: 82154 - DNA, 1075 bp, Homo sapiens
acttagtgaaaaatatagaacaaagttgtacatttatcattgctatacctatgtaaaaatatgtgcaagaaaggataatttttgcaggagaatgtaaatgaattatgttaagtgggttggattctgagtgatatttttttccttttgaaaattcgcacacaccgtcaatacttgagatatttgtgaagttaaatgaatagtggcatagaaattttgtttctttcctcggtaaatattaaattagtaccaaaaagcacccaaaaggaagaggttaattagattattccttataggcatatcataaaattgtttgtgtcatcttttaagagagttacacttaccaggagagggtcttgagagtaatcttcatatccttgacagcttagaagagggaatttatcattaaagttagtatgacatgagagatatattagtataatgtgatagagagaaagagaaccttaaaagaatgagaagccaagctttaaattgatagatgtcacatgtaccctgctgcttctaaacccagactttaccactgcatggaacgtgaggtatgtcattttcattagtgatatgataaagtttgtccaaatttctgaagacatgtaagccccataagttgttagcttttgaaaacgaaatataaaccattttacacttatttcttctccctattctttatacctgtgacaattctaaataggcattttgcccctttttgtgtggtgtcttcataaactttcttgcctgaaatataaattgtcatgttgagttacagtatactgtttgatacatgcttttattttccttcattttttggggtgggagactaatgggcaatgggcataactggttggcttataaggcatataacattatatcattggtatttgagaagcactgcagtgtagtggaaagtgtatgggatgagaaagagggagtcatgcttgcctctggctttttccctgagcaactgaaaggatggaattgccatttactgaaatggcagtgtctggaagagaaacagatttaggtaggcggtgtttgttataggccaagagttcagattggg

SEQ ID NO: 82155 - DNA, 815 bp, Homo sapiens
cgaggaggtggcggtgctggtgcagcgggttgtgaaggacatcactaacgccttcaggaggaacccacacatgtgagtcgcgcgcctccgccgcctccgagggtcgtcgggagcgggcgggggcggggccaagcgtccacccgacctcgggcggcgggcggacagcgggtcctggcccacgagcccttctagggaggaggcagagccgtgtcgggcgggaccgttgtcggccgccgctggcccggctttccgctaccgggacgcgctcgcggtcgagtccctagaagtgacctcaaaaaatcaaaacggaactactttctctgtccctccccaccttttcataggagttcacgaaactccagagacgtcccccgtaggtcgacatccttcctgtgtttaaggtactcgggcgcacacaacgatgtgggtccgtgtatgccttgtaaacacaactcttgagattcatcccggacgttggcaagagggggtaaccgatcctcttacttttaatgagcctcaaacccctcagtttactaactaaaggtggtttgaggctgcttttgactttagccttacttgccacaaaattgtaaagtgactccgataatacattgtgttttgaaaggtgaacagaacattctcaagagaagcttctgtgggcgcagtgtggagtctgggataaagcaaatgaaaccttgatactttttagcataagcggattcatagttacaaggagcatgttaactcatttttatcccaacactgctgccctctttaacgggacactgcagaactgacatatgtatctcttccat

SEQ ID NO: 82156 - DNA, 871 bp, Homo sapiens
aactgtcgcggccgccgccaacatggccgagaccagcgaggaggtggcggtgctggtgcagcgggttgtgaaggacatcactaacgccttcaggaggaacccacacatagatgaaattggcctgatcccatgtcctgaagctaggtataaccggagtcccatagtcctggttgaaaacaaactgggtgtggagagctggtgtgtcaagttccttttaccatatgtccacaacaagctccttttgtacagaacaagaaagcaatggctgaacagagatgaattgatagatgtcacatgtaccctgctgcttctaaacccagactttaccactgcatggaacgtgaggaaagagctgatcctctctggcactttaaatccaattaaggatttacatctgggaaaactcgccttaaccaagtttccaaagagtccagaaacatggattcacaggcgatgggtgctacaacagctaattcaggaaacctccttgccttcctttgtgaccaaaggaaacttgggaacaattcccacagaaagggcacagcgactcatacaagaagagatggaggtctgtggtgaagcagcagggagatacccaagcaactataatgcttggtcccatcgcatctgggttttacagcacttggccaagctagatgtcaaggtaggaatattactgtctcctgggcagactgcctgtctgcccttaaaatcttctggtagtagttcattctcagaagagctttgaaggagtagagaaactgatggtctggcaacttgagagaatcgcaacagctgctacctctggaggaaccctgtaattaaataaaaagcttgcattccccactagtgctgtttttggcagtcttaa

SEQ ID NO: 82157 - DNA, 558 bp, Homo sapiens
cgcttacatatagtgaacttatagttaagtaaatgatgatacagctttgcaaagaaacatatatagccactaaatacaaatagaaattaaatataaaccatttaaataatgagacagtcctatttgtccctatgggtaatgacctccaaggtacattaactcaaaaaagcatggaacagaagacagtggataagagtaataccctaacactgaaaaacagagagtgagagagaaaatatatttgttatgcttatgtacgtgggaaatccttctgaatggacacaaaagaaattggccatgattatggttagcactgggaagggaaactgcagggctggggacagagatgagagggagacttttcactgataccttttgtcccttttgaagtgctactatgtgcatatttaacgaaaaattacaatataggctgggcactgtggctcacgcctgtaatcccaggatttgggaagccgaggcgggcagaccacttgaggccagtagttcgagaccagcctggccaacacggtgaaaccctgactccactaaaaatacaaa

SEQ ID NO: 82158 - DNA, 608 bp, Homo sapiens
acacctctgcccatgcgccatggagcatgtgttaggtgcctgccgtgggtcaggcacttgattctcaaaacactgccgagaagctcttaccaacgtgacagttgaggctgagagaggttcatgagcttgctcaaggccacgggtagtaataagaggcatggccttggtgccaagtgcctcccaaacaaacagccggggccgtggtcctgcctaaactctcacatccacggcaccacgctgggcccaggcaacagagataaggagagccctggctcttgggatggggtcgcgccgattcacatgctgtgccacggagccccggcttccatccatgatgtgcccctgtggcgggataattgggaaacaacctttttctgattcccagagaactaatgagctgcaaaaagagattagacagggaagaattgctttcggggagaagccacttactcggctcgccttggtttttgctaacaacgtctccttaaactgctgtcaaatctttttctccctgtgtaggattcatcaatcttcgtatgcaaaagaacaccactgcactgcactgctaaaaattcacacaataaaatggactttaacttgcaaaactc

SEQ ID NO: 82159 - DNA, 530 bp, Homo sapiens
acacctctgcccatgcgccatggagcatgtgttaggtgcctgccgtgggtcaggcacttgattctcaaaacactgccgagaagctcttaccaacgtgacagttgaggctgagagaggttcatgagcttgctcaaggccacgggtagtaataagaggcatggccttggtgccaagtgcctcccaaacaaacagccggggccgtggtcctgcctaaactctcacatgctgtgccacggagccccggcttccatccatgatgtgcccctgtggcgggataattgggaaacaacctttttctgattcccagagaactaatgagctgcaaaaagagattagacagggaagaattgctttcggggagaagccacttactcggctcgccttggtttttgctaacaacgtctccttaaactgctgtcaaatctttttctccctgtgtaggattcatcaatcttcgtatgcaaaagaacaccactgcactgcactgctaaaaattcacacaataaaatggactttaacttgcaaaactc

SEQ ID NO: 82160 - DNA, 335 bp, Homo sapiens
caactcctgggctcaagtggtccgcccagccttctgaagtgctgggattacaggtgcgatccatcttgccctggcagctcctgcttttcaccacagcattcacgggagtttgtaggatttctgtgctggggaaacgtgtactcagttaatagagccaggtggaagttgtactcagaactggtggttttctttggaatgaaaaccgtgcatgttgggggctcttagtgtccccgttcggttgtaggcataacacccttgctttgtgtagggggagggctttgcccgtgccctggtgccccggcgcagggcatcgaggcctgcagatcagaaccgca

SEQ ID NO: 82161 - DNA, 577 bp, Homo sapiens
gacaccagggagtcctgggaattaggaaacaaaacagagaagggaagaaaaaaaagcaggaactgaatttccttcattcattcatttatttttgagaagggtggagaagcccacagatttatatctcggttgggtgaaattgtgttactgtttatctgtacctttttccccctgtggcaagagacgtggagaatagacactcactcccaaagataccaagttccaaagcactgagtcatgagtccacaatgaaatactaggatgcagccatttcctacctttgtttggaaatgaactgattggaccaggcggatgtaagccctcagctgcagggctttacagaaggaaatgcttttggtctctcttaggtactcgatgctgttctgtaacttctttgtatttgactgaaacaaccaatgtgaaaatgtttcctagactatataaaattcagcgcatgcacccttctgtctgtttgtgcacatatactttttatgtgatggtagggaaagcatcaactgcttttaatgcagtgaatttttaatgtaaccttacgtattaaactcttcacaagactgtc

SEQ ID NO: 82162 - DNA, 260 bp, Homo sapiens
tagtagagacggagtttcaccgtgttagccaggatggtctcgatctcctgacctcgtgatccacacgccttggcctcccaaagtgctgggattacaggcgtaagccaccgcacccagccctctgtgtggttatattatcaatttaatatgtaatagcatctgtggtttctgtttatattcattcagttttatttatttatttatttttagacggagttttgctgttgtggcctagactggagtgcaatggcacgatctca

SEQ ID NO: 82163 - DNA, 829 bp, Homo sapiens
ggccatttctcatggaaaatcaggaaaagagaatgaaacattaattttcatgttgagttattacagacatcagcagtatggaccaagcacccatgagataacgagtcctgaactgggcaccaagagagggtcacagatataaagagtttgccttgagtctcagatgaaactttgaatattggacatttgagttgatgctggaacaagttaagagttttgaagactatgggatagaatgactatattcaacactgaaagaacgaagacaatggctcttccagaggaagaaagattatcctgtcctggctatcttgtctattaccaacattccaggatgaagaaatatggtgatacactcaggccactggaatggcctccagtacagcagtgaataccagtggaatgcaacttcttttgctttagaagacaagctcttagcaatgtcaagtttccaggtacgaccgagagatattcaacatattataatttccactaagatgggaaacatttcctaggggttatttctctttgacagcagagaagtatccaagttattctagataataaagcaaagttttcctcaagtcctgtattatatgagactgctgtttctgaaaattatagtcccacagcaacctacgaagtttagagatcaatatttgatttttctatcttgctaaatattcttcaaatcaagtattagttgtccctgtcactcagcatgaagaaaaactgtgttaaagaggacctggagaagtaaactgactactgacttaccagactccagaactataacaagtaaatttctgttgtttataagctacccaga

SEQ ID NO: 82164 - DNA, 636 bp, Homo sapiens
atctccagtcaaagctgatagtttatgattaaaattaaactttatgacctctttgactgctgctttcattttttcctttagagtacatttaagacctaaaatgataggtatctaatttaattgtttgctaaaaggagacaaaaatctctaacataatcaaaaatttctaagatataagaatatgaggaacagttctaggctcaatgtactgaaatcccccaaatattagaccacagcaaccctctccataccatgtatatacctggctcccctacccatgcaagcaaaatccaagtgggtagtctggacttccaccctagtgaggctacaaggtggcatctcaacaccctaactggggtagagtcaaaggctatgtagacaagtagggagccatgataatggtgtcagcggagaccacctagagagcctagatttccacccatacaggaagtaatacggtgttacttactccttctcctagttggctagtatcaaaggaggcctagtggaaagtcgggacttttcccattgcccagaggtgagaagaccactcccactgcagtgtcactggagaccatatgggaaactgaaactgccaccctagcctagcagttgctgtggctaaggaaatagctc

SEQ ID NO: 82165 - DNA, 589 bp, Homo sapiens
  misc_feature (586)..(589): n is a, c, g, or t
aaactcctgacctcaggttatccacccacctcggcctcccaaagtgctgggattacaggcatgagccaccgcgcccggccggacaccattctttttcaatgaaacagtctaattccagagaatgagacttccagtttgaatgcaaagtgtgtggtcccaaagttgaattcttttgaacccaagtacatgcctgcggttgggaggaacacttaaagatgaagcaagttcggaggaaagtgttaactgaactacagagatggtcactgataaaacaagttcttagaagttctcagacacacccagaggtgaagggcagccaaaactatcaacacaatggaaaaatgagctcacccaactgcacacacagagcttctagaagggttaacagctcttgccataggttcctggttgtagtttacaatatctgcctttaccaccctctgtgactgttctatttctgctttgtttaatttgattccaaggatttcagcaacaactttttgaaaacacaggaagacagagtctcttgccttggctgaaacaaagtggctattaaaaccattttcctggcaaaaccgtaaaaaannnn

SEQ ID NO: 82166 - DNA, 472 bp, Homo sapiens
catttgtcaccccctacgctacccagtcatcatgaatccccatctctgtgtcttcttagttttggtgtcttttattcttagcctgttgaactcccagctgcacaatcagattgtgttacaattcacctgcttcaagaatgtggaaatctttaattttttctgtgagccatctcaacttctcaaccttgcctgttctgacagtgtcatcaataacatattcatgtatttagatagtgttatatttggttttcttcccatctcagggatccttttgtcttactataaaattgtctcctccattctaagaattccatcatcagatgggaagtataaagccttctccacatgtggctctcacctggcagttgtttgcttattttatggaacaggacttggagcctacctcagttcagctgcgtcctctttccccaggaagggtgcggtcacctcagtgatgtacactgtggtcatc

SEQ ID NO: 82167 - DNA, 491 bp, Homo sapiens
aatgatggaagagtccccaaatcatcacaaataccatttcattcattcaacatatgtttactaattgctgtctatagaagcagcactgacctaggagctacggaaacaaatgcaacgtgttagaaagactttagaaatgagaactcttaggactcttggtcacaaaacatacccagattcagcatcccaaaagatgtaatgtttttcacttaaaaacgaagagatctttaatttttcgtaagtctctttttaattaaaagaagagccctgcaggtgccaaaacatgttttggtaatctagattataaaaattgttcaagttattggagacaacaatcctgtaattcaagattgagctactggggaaccattaacgctagaagtgagtttctgaaaatgggacgtttataagagaagtgtgagttcgggtcagggtagcagggtcctataaccaaatagcagctgtggttgtgaagaaagggcaaggggctg

SEQ ID NO: 82168 - DNA, 188 bp, Homo sapiens
gctatagagagaaacaatccagctgcctggaaactgttattagtatagaagtggcttaaagaaaagcatcttcaaatacttgactcagcatatctttcttctttagacttacataatgatattcatctctccattagcaattgaatccaggcataaccgggctcagttacacagcttgtctgtgactg

SEQ ID NO: 82169 - DNA, 730 bp, Homo sapiens
ctagaggatccccaagcagtgaatacagacacatacggtttggcttttttcctttttgcttttttttcttttcgcttttacatatattttttattttatgcatgatatttacctattaaaaaaaataaagggtgggagtgtctcactttgttgcttagcctggcttcaagtgattctctcgccttgatcttccaaacttgctggattagaggtgtgcgccaccactcccagcctcttttaacgtttaaattttgaaataaagtgctgttcagaaaggttgtggaggggacttaaatctcctgggtgtgttgcacctgccaggtcgctagtaagtggctaagctggcctgagaacccaggagtcccgtgctgacactgttgcctgctgtgctgcccactgtgcggtggtatgtgggcatctgtcaccttattctactgcagtgtgtgtaagacatctgcccgtctcgtaggcaaagcttgccatcaaagtgctgggtgatgtgtgtctctcctgtgtctgtgtgcccctttctccccagcctgcattttattaataattggtgtaatgtctcatcttgacctttgcctgtctttctgttgggttggtttgtttttcattgctcgctctttctctcctatgggggctaattagggaaataaactgagtagctttttaaaaatgtcatttcccaggcccctgccccagagattctgtgtggatcagcaggagg

SEQ ID NO: 82170 - DNA, 453 bp, Homo sapiens
tctgcacacacgtcccctgtgcctgccatgggaccacagacagaggatgtgctggagcttgcactttctgtgtaatatgccttggaggtctctacatacagacacatacggtttggcttttttcctttttgcttttttttcttttcgcttttacatatattttttattttatgcatgatatttacctattaaaaaaaataaagggtgggaggatcacttgatcctgcagtgagctgtgactgagccactgtactccaggctggacaacagaacaagactgggtctcaaacccaaaaaacctacaaaaaataaattacggaagttggctattagtgttctgtaccttattaggaaatcgcttgaacccgggaggcggaggttgcagtgagtcgaggtcgcaccattgcactccagcctgggcaacaagagcaagactccgtctcaaaaaaaaaa

SEQ ID NO: 82171 - DNA, 402 bp, Homo sapiens
ctcctcggttcacgccattctcctgcctcaacctcatgagtagctgggactacaggcgccggccaccacgcccagctaattttgtatttttagtagagatggggtttcaccgtgttagccaggatggtctcgatctcctgaccttgtgatcctccctccttggcctcccaaagtgctggggttacaggcttgagccaccgcgcccggcctcagggtttcttttataactgtgatcaggaagatgtgcttttctttctacttggttaagcaactaatcaaactcagcacaacaaaacaaagattctccttttctcccaagaagttcaacagttctagcgttgtagaacatttcacaaataaaaccatcctagtttccttttcccataaacagttgaacacatc

SEQ ID NO: 82172 - DNA, 668 bp, Homo sapiens
ctgtggggaaatagtgctttaactgcttcaactggatgagtcaatgcatggtgcggggacaactggatatccatgtgcaaactaataaatttggatccctacttcatatcatacacaaaatttaactcaaaatagttcagagacctaactgtaagaattaaaactataaaactcttagtaggaaaatagctataaatctgcatgatcttggattaggcaatgggttattttagatatgataccaaaagcataagcaacaaaattaaaaacaaataagttgaacttcatcaacatataaaaaggacaccatcaagaaagtaagaagacaacccacagaatgggagaaaatgtttgccaatcacacgtatttgataagagtccactatctagaatatataaaggactcttgcaactcaacaatataaagagcacctgattaaaatgaagacaaatgatctgaatagatatttctccaaaaaaaaatacaagtggccatttaacacatggaaagatgctcaacatcattaatcattaggaaaatgcataccaaaaccacaatgagataccatttaacacccagtagaatggctataattttcttaaaagaataataagaagtattggtgagaatgtggataaattgaaactcctacgttgctggtaggagc

SEQ ID NO: 82173 - DNA, 972 bp, Homo sapiens
aaaagatttggatcagaaagattctttgctggctagagttccttttcggatggtagttcaagcagtctttaatcatatttttgttgattatttattagtttccctgggaaatcaaagactcagtaacgtaaaatgtgttttccttaagatattttatgaatcagaacccacagtaaagaaataatgggaaatacatttcctttgctgatatggactaattgagaattaaaatccctttctctagtcattatcccacatggaaatgctgaatgacccaactggcccaattgcaccaaccacagtttctgcctagacaaaactcttatgccactagtagataaagagagagctttctcagtaaatcaaaactgcagagaactagaactaatttaagtgaaaggataggctccaagcccgctgtttgggtaaacccacactgaaccaagtgagcgattgatgaaacttaatatatgtgtattccagtcatcagcctggagtatgtgtaatgcaagcccatggtgtttgtcactgtgagaaatggaaaggcagaccttcattctcaactgtgtggggctgctagcctgtggcagctttggtcaacatcgggcttgcttttgggtgagccagactttggctggtttcctgatggaggttaggggaattgtgaaatgtgtctccttacacagatcgtcctgatcaaatgaaataaaaaggtattttaaaaataatttgcttagtgaaatacaaaggaaataggatgcatttcatactattaaggccgatatggttttgggggatacgaggtgtacatacgtgaaaaatttgaaaacaattcagagtgaaaaagaatggtcgtataacctaatgtaaatgacgagttaatgggtgcggcacaccagcatggcacatgtatacatatgtaacaaacctgcacattgtgtacatgtaccctaaaacttaaagtataattta

SEQ ID NO: 82174 - DNA, 261 bp, Homo sapiens
tctaggttgggttactgggtgatgatggtgcccctccaaccttgggagatccaaggctggggtgaatggcgaggttgttttctgctatttcaaatttggggtgcctgtgagatagcaggaggcctcagatttgaagtctggagctcaagagtccagacccagatagtgtgtcagcatcgcactgacgcagcgaagtgcatgtctatgaggtggtccaagtcacacggggagaaaccaaggacaggccctgaggcacagcag

SEQ ID NO: 82175 - DNA, 221 bp, Homo sapiens
aaattttagcattagtcaggcacagtcccagctacttgggaagctgaggcaggaggattgcttgagcccaggagttcagggttgtagtacactatgatcatacctgtgagtagccattgcactatagtctggacaacatagcaagacccagtctcctaaaagggggaaaaaaggagaagaaacaggggaagcagccaaaatggccgaatagaaacagctca

SEQ ID NO: 82176 - DNA, 535 bp, Homo sapiens
ccgctcccgcccctgccgctcattcctgtccggacgcacctgcagctccccggggagaagaggacgccccccatccgctcccccacacaggcttgcgcccagagacgcggccagccggggccagagagcaactggaagaacatgcaggccgtgcaagaccaatgaacgaggcaatctacgcctaggatgcatagcgtagagacgaacggatgcttcgagagaatcggagcagacgcagcagctctaggccaatgatgattgcgacggaaatagaaccaatgtaataaacagaatacaagaacagttagaagcacgaaaggcacgagacaacgcaggacaccggacagagcagaatgtgccacagcgagatgacgcaagcgcgaaacgaatcaacaagcagacccatgtgagacaggagccacaatgaggaagaaacacaggaataacagagaccgaagcgtaacgggatggcacaacacataaagtcacaaaacatagaaacatacagagatatccgtaaagggagcacacatga

SEQ ID NO: 82177 - DNA, 438 bp, Homo sapiens
tgggcagtgctctttggatccgatgtgctgatgtctaggactgactgtttttggtatgggagcttctgtctgcagtgtctagaatgggggttggagggactatggggaacagaggtggccccagagcttggacatctgggttctcatgctggccttgctgctcataagcaggtaacacagggttgagttcctcctttgcctggccagccaacctggaagacctagccttctggctgtcagtgtccagagctctggagaatccctgaggctacatctctgggtgggggaaggtcctctctgtatagatggccctccaggggaagtctgcaaggatccagacttcagaataatagagttaagtattaactaatccaagtggtcctagcacatttagcacatatggcatgctcaagggtgtgcaattgtgcagtcatcaaa

SEQ ID NO: 82178 - DNA, 997 bp, Homo sapiens
  misc_feature (47)..(47): n is a, c, g, or t
  misc_feature (379)..(379): n is a, c, g, or t
  misc_feature (618)..(618): n is a, c, g, or t
atcaacagccaagaatgtggggattgcagtcagggcttccttctcantcctgctctacatctactgaatcctcaaccacactcctttccaatttccagaatctacttcttctctacatttctgcctcccttcccttaatgcagttcctcctccctttggtctcagtagcagcctcagaatgggctgtccctgccggcattttgtcatcctccagataaaggataaacttattcagatgacttccaatgccaggcacctccgaatccccacttgccatgtgagcctcatgccctccacctcctcctccatatcgtaaaataagatgtcctgacttcctgtgcgtgaggcttgccaggacccgcaatgctccctctctcanttcagggcttatcacttgctcttttcctctccctggaaacctctcctttcataagttttgtaaacaccttctaacaatcacttgggatgcagttctggcatggcttcatcctagaaacctttttcaaccaccgtcctacagcccaggatgtgggcttagagcccctctcctaggctctgcagcacccaacacaggcacctgttaggacccttcacagaatattacgcaatggccctttnggttcacattcccattttatgtttttaactagagatgctggggaaagtttttttaaccttttccaaaatgacctacatgtttgtgattctttccacgtttctttctgtcaattcacttttggaaaaaaaaaaacctttattggagtataatttacatagcataaaattaatatgttttggcatggtggctcatgcctgtaatcccagcactttgggaggccaaggcgggtggatcacctgaggtcaggagttcgagaccagcctggccaacatggtgagaccccatctctactaaaattacaaaattagctgggtgtggtggcggacacctgtaatcccagctacttgggaggctgaggcagaagaattgcttgaactc

SEQ ID NO: 82179 - DNA, 390 bp, Homo sapiens
tggtatcactgttctgttacgtaatgttcagtaaatatttaacaatattcagataaagagtcatcaattagaaatctttaccaaacttcttacccataaaggttgtctattggaatgcatgtccagtgtttaaaattgaacttttcatccatgtgtgtatcattgagatttcactttccttagccagctgaacattgagaccagcttattctgtagacttttaaaataattttacctattttccccttagacttagaataattgatcttacaatatttattctatgtcataatttccttctgtgttatttattataacattacattaaccatacatatattttaaaataatagtggtttagttttaaattactatttttattttgttttt

SEQ ID NO: 82180 - DNA, 658 bp, Homo sapiens
cacttaaggagctcgggccagcgcgagggggagcagggaggaagcccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaaggacccaaacgaggtgccgacttgcacccagaaagctcccaagtggctcatcagccca

SEQ ID NO: 82181 - DNA, 1316 bp, Homo sapiens
cacttaaggagctcgggccagcgcgagggggagcagggaggaagcccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcagggtgacagctctggggaaggggtgtgtgacaagagccccctggagagatactacgactacagcggggccttccggtgcctggcggaaggggcaggggacgtggcttttgtgaagcacagcacggtactggagaacacggatggtgagtgggggaggggcacgggcccagaggagcagggagtcaggccaggccggcttggggcagggaccctagatggcagagttgggatcaaacgccctagtgcagtgctgctctgagtctctgggtgaccttggacaagtcccacagtctccgagcctcagcactcccagctgcaaaagagcagaggcaggtgtcaccagtggagtgcccactgcccacagggcaggagaagggggccagcgagcagctctgctctgctttgatttgaatatggcattgggttctggttccacctgaagatgagggtctgattttttaagcaatttgcaaaccccttctgcatttattgctggaattctgaaaaatttgtttttgctcatcagttattttatatgtggaggtacaatttgtataggaaagttagaataaaatactttgtttctttctccttattttcttgttttcagaataaatgagttgcttcactatca

SEQ ID NO: 82182 - DNA, 876 bp, Homo sapiens
  misc_feature (838)..(838): n is a, c, g, or t
cacttaaggagctcgggccagcgcgagggggagcagggaggaagcccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcagggtgacagctctggggaaggggtgtgtgacaagagccccctggagagatactacgactacagcggggccttccggtgcctggcggaaggggcaggggacgtggcttttgtgaagcacagcacggtactggagaacacggatgaaagtccatcacnaaggcaaacatggaccatatctgagtttggcgaaggcg

SEQ ID NO: 82183 - DNA, 1303 bp, Homo sapiens
gcgagggagactcacttgtcactgcgcaccgttttctgctatctgatttttttactatgatatctgagtcctgcaaaatcaatgattagtattttttttttaacattattaggaaaacaaggtgaatccctggcctgggaaagggggagagccctgggctctggttgggctcctgggacagatgagaaggacagcacagccctctggggcttggggtggggccccaggccatctggtaggtgtcccgagttctttgctgagcaggccagctgggccaggcttggctgagccacatttccttgcaggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcagggtgacagctctggggaaggggtgtgtgacaagagccccctggagagatactacgactacagcggggccttccggtgcctggcggaaggggcaggggacgtggcttttgtgaagcacagcacggtactggagaacacggatggtgagtgggggaggggcacgggcccagaggagcagggagtcaggccaggccggcttggggcagggaccctagatggcagagttgggatcaaacgccctagtgcagtgctgctctgagtctctgggtgaccttggacaagtcccacagtctccgagcctcagcactcccagctgcaaaagagcagaggcaggtgtcaccagtggagtgcccactgcccacagggcaggagaagggggccagcgagcagctctgctctgctttgatttgaatatggcattgggttctggttccacctgaagatgagggtctgattttttaagcaatttgcaaaccccttctgcatttattgctggaattctgaaaaatttgtttttgctcatcagttattttatatgtggaggtacaatttgtataggaaagttagaataaaatactttgtttctttctccttattttcttgttttcagaataaatgagttgcttcactatca

SEQ ID NO: 82184 - DNA, 506 bp, Homo sapiens
gcggccgcacttaaggagctcgggccagcgcgagggggagcagggaggaagcccggctgctgcggacctcctcggacccggacccagccccagcccggccccagccagccccgacggcgccatgcggggtccgagcggggctctgtggctgctcctggctctgcgcaccggtgaggccccgctgtgagagccaaaggcgggcgggggtcccggggcgccgcggcccggctgagcaggtcccggggctggaaatgtgcctgagcctgcggctccggggcagtgagacgggggaggcaggggctcggggtcgagtgaggacggcggagggaactagcactgaagcgcagacggggaagtctggaaggcttcttggaggaggcggcctcgaacacccgaggcttccgacgctccaaggagaagcgcgggctgaggcgtggtggggaggcctcggggtgtggagaggagctcccggagggcggcccctcccgacgggcgcaggaactcag

SEQ ID NO: 82185 - DNA, 560 bp, Homo sapiens
attgaaagaatataatttcagctaaaatcctagaagagggtttgaaataatttaaagaaaatgaccaagtttttttaaaacctacgtttcaaaatctaaatggatatgtgttatttgggacacttattcattatgattatataagaagacaattcttgtttcccttataagtatggactgtatacattaaggaaaacaatgtttaatccttattttttaatacagaagtctcaaggttcttgtcaaattttgcctttataagcttattacaaaattacaacttactttactgaagtttataatggaagaagtccatatagcaaaagagctgttttaaatcagaaggaaaaaaggttactctggttgttaatctgcttggcaaatattccttcataatttgtgaaaagaatgcaaatcagcattttaatatgaattttgaaatgaggtatggttttttgtttgtttttttcagaactcagtctgaaaaacaactgtgagtgtagcatgggtcaaatttggtttttagtccatttgctttatcaacatcacggcttcagaaa

SEQ ID NO: 82186 - DNA, 355 bp, Homo sapiens
gaaagggacactgagggtaggaaagaccatcttgaattgctgacgccacccctcccccaaccccaggcagcactgactgcagcaatgcaagtgactccttctgcttgaggagacgagagcaaggagtaaaaaggactttgtgttgtatcttggataccagctcagccacagctacaacagggcaccggcagagtcgtgaggtcgccattccaggccccagctccaagatgacatttttagatacactctggcccagaaggaaacccactgccttaaagggaaagacccagtcctggaaggattaatcttggcttaatcttaacctgctgactaaagagcccttgaaccttgaata

SEQ ID NO: 82187 - DNA, 509 bp, Homo sapiens
ttttacagacgtgtgaataatattcatttttgaatcaagagcttaagaaattaggatggctaccctagtctaggatcctcatattactaatttcttccgcctccacaaacactctgggtagggagattctgccattaactagctctgctgtcctaagcaggtggcttctttctgcctcacagccctgttcctcctctttgaggtgtaggtgctggacaggatctcctatgcctccagccctaacgttcctctgcctgtctgcagggggatgcaggagggtggctgcgggaccactgccttcagaccggggacgcctttctcatcgtcttctcagtcaccgaccgacggagtttctccaaagttccagagaccctacttcggctccgggctgggaggccgcaccacgacctacccgttatcctcgttggaaacaagagcgacttggcccgctcccgggaggtatcactggagggtgtgtatcctgaacagattccatacttgcgatctca

SEQ ID NO: 82188 - DNA, 407 bp, Homo sapiens
cggcgtgggcaagagcaccctagcaggcacttttggtggtctccagggagacagtgctcacgaaccggagaacccagaggatacctatgagagacgcatcatggtggataaggaggaagtgactctagtcgtttatgacatctgggaacagggggatgcaggagggtggctgcgggaccactgccttcagaccggggacgcctttctcatcgtcttctcagtcaccgaccgacggagtttctccaaagttccagagaccctacttcggctccgggctgggaggccgcaccacgacctacccgttatcctcgttggaaacaagagcgacttggcccgctcccgggaggtatcactggaggagggccgccacctggccgggacgctgagctgcaagcacatcgagacgt

SEQ ID NO: 82189 - DNA, 1057 bp, Homo sapiens
gttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctgacaggattccctcttcctgtttctcgccatcttcttctttttttggctgctcagtatttgagctatgtctgcttcccgcccacctccagccagaggagaatcagtattgagggtccctgctgacccttccgtactcctggacccccttgacccctctatttctgttggctaaggccagccttggacattctccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttgaaaggtgggcaaagttccctctgactcttcccccactccccatcttattgatttaatttaatttttcactccccagagtctaatatggattctgactcttaagtgcttcctccccctcactacctcctttaatacaaattcaat

SEQ ID NO: 82190 - DNA, 974 bp, Homo sapiens
gttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaattctcatttggtgttggtgcttttccctttggctttttcaccaccgtcttcaatgcccatgagcctttccgccggggtacaggtgtggatctgggacagggtcacccagcctccagctgacaggattccctcttcctgtttctcgccatcttcttctttttttggctgctcagtatttgagctatgtctgcttcccgcccacctccagccagaggagaatcagtattgagggtccctgctgacccttccgtactcctggacccccttgacccctctatttctgttggctaaggccagccttggacattctccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttgaaaggtgggcaaagttccctctgactcttcccccactccccatcttattgatttaatttaatttttcactccccagagtctaatatggattctgactcttaagtgcttcctccccctcactacctcctttaatacaaattcaat

SEQ ID NO: 82191 - DNA, 783 bp, Homo sapiens
  misc_feature (746)..(746): n is a, c, g, or t
  misc_feature (757)..(757): n is a, c, g, or t
gttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaaattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctgacaggattccctcttcctgtttctcgccatcttcttctttttttggctgctcagtatttgagctatgtctgcttcccgcccacctccagccagaggagaatcagtattgagggtccctgctgacccttccgtactcctggacccccttgacccctctatttctgttggctaaggccagccttggacattctccaggaaggcctggggaacgtggtaaatcttttgcctggggaaagaggattggatgangagatgctttntcctttctaagctttgctttcctgaa

SEQ ID NO: 82192 - DNA, 1008 bp, Homo sapiens
gttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaaattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctgacaggattccctcttcctgtttctcgccatcttcttctttttttggctgctcagtatttgagctatgtctgcttcccgcccacctccagccagaggagaatcagtattgagggtccctgctgacccttccgtactcctggacccccttgacccctctatttctgttggctaaggccagccttggacattctccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttgaaaggtgggcaaagttccctctgactcttcccccactccccatcttattgatttaatttaatttttcactccccagagtctaatatggattctgactcttaagtgcttcctccccctcactacctcctttaatacaaattcaat

SEQ ID NO: 82193 - DNA, 421 bp, Homo sapiens
tcctagtgattttgctgtttaaaatgcctccctcctccgaagcttggtattgaagtagtgtccagtattcctaagcagaaggctgtgaagtgccttacagagaaaatacgtgtgttagataagctttattcaggtaggagttaaggtgctttagttctgagttcaatggtaatgaatcaataatatattaaataaggtttatttaaacaaacacataaagcaaggttatgtcttgattgatagaaatgttgtgatcgacgtttgcaggaacccaacactgtatttctcctggggatccatggttcagtgttccctaattcagtgtttccattatgttcagtaggaacataactaccaagaatagattgtaacaccttgggtgggtcaaagaaattgattggacacttcagtgtttctcatc

SEQ ID NO: 82194 - DNA, 1642 bp, Homo sapiens
  misc_feature (114)..(114): n is a, c, g, or t
  misc_feature (293)..(293): n is a, c, g, or t
  misc_feature (295)..(295): n is a, c, g, or t
  misc_feature (298)..(298): n is a, c, g, or t
  misc_feature (433)..(434): n is a, c, g, or t
  misc_feature (510)..(510): n is a, c, g, or t
  misc_feature (599)..(599): n is a, c, g, or t
  misc_feature (801)..(801): n is a, c, g, or t
  misc_feature (1456)..(1457): n is a, c, g, or t
ggatccgctgtcatgggtaaactttccagtagttcttaaataaaaataaaataaaaaaccttgtctcttgtatctgctttttcatctatttattccaggtttctgtcattcttnttgaccttgccgtgtgtgtgtgtgtgtgtgtgtgtgtgtgtgtgtgtgtgtgtgttgagacaggatctctctcttttgcccaggctggagtgcaacaatgcaatctccactcactgcaacctcaacctcccgggctcaagaaatcctcccacttccgggcgtcctaattgagaagattnanaanaaaacccagcgggaaaagtttgcctgccattggcatggctgatgaagactagaagttttagccagtctcaaggggcagggttctgtgaaaaggaacagtgtggtttgggagaaatggataaactgagcctcgctnnccctcgtgcctgggggagagaggcaacaagtcttaacaaaccaacatctttgagaaaagataaacctggagatatnataagggagagctgagccagttgtcctgtggacaacttatttaaaaatatttcagatatcaaaattctagctgtatgatttgttttganttttgtttttattttcaagagggcaaatggatgggaatttgtcagcgttctaccaggcaaattcactgtttcactgaaatgtttggattctcttagctactgtatgaaaagtccgattatattggtgtgttcttacagttggggttttgcaataacttctgtattttaatataaataaattcctaaactccctcccctctcncccatttcaggaatttaaaattaagtagaacaaaaaaaccagcgcatctgctacagtcgtcactcattgtcatggggatcaatcttcactaaacttgaagcagtcgtagctttggcagtgttttggttcagacacctgttcacagaaaagcatgatgggaaaatatttcctgacttgagtcttcctttttaaatgtgaatttgtattctttttaattattttaaaatatttaaacctttttcttgatcttacagatcgtgtagattggggttggggaaggatgaagggcgagtgagtctatggataatgaaataatcagtgactgaaaccattttcccatcatcctttgttctgagcattcgctgtactttaagatacccatctttttctttttaaccctaatctttcacttgaaagattttattgtataaaaagttccacaggtcaataaatttagaggaaaatgagtatttggtccaaaaaaaggaaaaataatcaagatttagggctttatttttctttgtagttgtgtaaaaaatggggaaaaaaagcagaattttaatgtgaagacattttttgctataattattagttttagaggcattgttagtttagtgtgtgtgcagagtccatttcccacatctttcctcaagtnncctctatttttatcatgaattcccttttagtcaactgtaggttatttaaaataaattccttcaacttaatggaaaaaaaaaaaagaaaccctcccacctcagcctcctgggttcaagaaatcctcccacttcggcctccagagtagctggaactgcaggtgctgccactactctggctaattttt

SEQ ID NO: 82195 - DNA, 814 bp, Homo sapiens
tttcaaacacaggaagcagtttcagaaagaaatacgagagagtaaagagtggttaatgttgaggctgggtagcagcgacttgatctgtgctctccgagagagcgtgccaggttctgcagtgtggctgctctctgctcagctcttttttttttttaattattattattattatactttaagttttagggtacatgtgtacaacgtgcaggttagttacatatgtatacatgtgccatgctggtgcactgcaccactaactcgtcatctagcattaggtatatctcccaatgctatccctcccccctccccccaccgcacaacagtccccagagtgtgatgttccccttcctgtgtccatgtgttctcatccgctcagctcttatcctgggtgatggagcccaggcttggggttccatagattgagggagaagtaggagtgtctctgtcagttaacttctatctggacaagtcagcctctctgaacttactgcctcacgtgtgaagtggggctgacacttgctcacagcagttgagcagattatatgagctgaatgttaagtgcctggaatggtgtttgttgccaataccactgggataaatgtcagtggataaaagactgtgatgattatggttcttgttcatggtcttgatagagtagaataatgttctttaaaagttcacaggaaccagtttttttttttggcttgtgtgaaataatatgcgtaaatggtcataacaaaagtagccaacattttatttatttatttatttatttttatttttatttttttgacacggaatctcactctgtcgc

SEQ ID NO: 82196 - DNA, 402 bp, Homo sapiens
atttaccttctagagttcctttagtaaagtgtcccactgccttgaaataaggaagttctccttcatttctaacctaaattactcctgttaaaattgaaatttatttctttagaagacattcaaggcagcaaattagcatcctgtgtcattatttctcaggttattcatgcacactaatgcttgagactcacggctctacttcctaaccattagaagcttcaggtttcatttctccagtgctaataattctaattttttcttttttaataggttccatgatttcccttctccatctctttatacctatctcaggtttctttccacccttagattgttctttccacctcaacctttattcctcttccccctaccttcccatccctaaatatcctctcttaaatg

SEQ ID NO: 82197 - DNA, 428 bp, Homo sapiens
gctgctttttcttttttttgaaggagcccccaaaactcacacatggggaaaaaggagacttttggagttaagagtgaaaatgcccaaactccacggccggcgctctgctctgcccgccaaggatgtacaagaggatttttatcaaattcggctcaatgtgccccagtgtcaattaatcacccccgtggtgcgtaagacaacttggcacttctgggtgtctgggatctttgagaacaaatcgaaaggaagaagagacatttactaaaaatggcaacctctttttaaggacggagccctgcaactcagccaggggtgaggacacatttttcagaagttgtgtttggtggggggattgttaatttctcaataccgctgacgcacagactcgacaatatcaagaaggcacgtttctgcgcccgcttgcttgg

SEQ ID NO: 82198 - DNA, 447 bp, Homo sapiens
gggaacctctctggggtccctttagaaagcactagcctcattcatgagggttccagcctcatgacctgttaatactcaaaggctactcctcctcataccatcgcattgcgggttaggatttcaacatacgaaatttagtggggacacatttagtccattgcactgcccttgagcagtttgcagggagaaagattcgcctacctgcaatggcacctccagccctagaggttaaagagacacatactgacctgcagcttccaccagacagcaggttatcacagcaccacttgggagcctgatgtcacaggaatggttattgatttagcccctcctataggctatggaatatgtgtctcctgcggacagactttgtctctttttaaatttatttttggttcatgggtgtattcccagcaccaagaacagcgaacagcacatagtacactt

SEQ ID NO: 82199 - DNA, 693 bp, Homo sapiens
tcattctctgggtgtcactcctgtttgtcttcactcttgctctccacttttccccatccaatcttaactgactggtaagtttgggaagaggaaccagacacatgtagccccatgccttccattctccttctctgtgggactcctgtccacaggaagtatatgctcttatctaagcttccatactgatagcatcccaggctggctctgcccttggggaaggcctgtggatttcagccctgtctgggacttgaggggtctaattcttgggtgaaatattataatcacagggttatggtacatttaagccacattcttacatatgtgcttaaagaatagtaaggtggtacttcaacccaaaagcatcttacttttttgtgttatttttcaaatgcctcagaaagccatttggatgtggagagataggtgtaaattattgagttcacctacagcccaactgtagccatagaaaacactgattataaaaagcatatttaaaacatatctgctttaaaggaggactaagtaacataaaattattcttatatcccaattgtcaacatgattactgcctgttcttttgtttcccacaatgatattgtttgaataagggtagtactggaatgaaaaattaggggattattttgtgtttaataattggcatctaattcctctttggcctttactacatatacc

SEQ ID NO: 82200 - DNA, 938 bp, Homo sapiens
gactgggtggatgaggctcaccccggcggggagaagggacgaggaggggcggacagcggagggtccgggagtgtccgccataaagtcgtttgaggtgaccgttgcgtaattgtgagtctgtgagagaagatgtgaagtatggcctcgtcccggtcatctgggcgtgcgggtcccgggttttgatcgcgcgtttgtgtagaataaaagaaatgacagccaccatagaggaactagccaaagttaatattagtcggccagcccagagtcccttcaggagttctgtgtgactgggaaaggaaatctgacagcaccgggcacgtgacagtagactacagggaattcaataagagtttgactcttcgtcaacaataatctggcgcccaaacgtggggcctcagagaagactcaggacccctaaggagttgcctgaaaccggagctaaggtaccagcaggggcccattgaagtcccactgagttcaagcttctcctccggtggaactggtaagtcctcctgagccccagacctctccttgaccagacttttcttaggcttccctgagccctcttcttgagtaggcctggaccttggatttctgtgtccatccttgctgcacccagttttagcaagaatcctgttaagtaggtttagtgagaattcccttatccttgatcaggttcctcatcttccacccttaatgtctaagtccttggcctgcctttagcaggattctacccttaatacctaatcaagttcctgtttgtgatttcccacccattgacccccttactcttatagttggctacaaaaccaactgttgttgctatattggggagttgagttcactgtctctcccccattgcaattgtcttgaacagtattacttaccgtttacacacgtgtattcttttcctgtttccctcatttgcatgagaaatg

SEQ ID NO: 82201 - DNA, 486 bp, Homo sapiens
gtgagaccctgtctctaaaaacaaaacaaggacccagcctagggtgaaggcagttctggaagtggagctaggatgggaggcgtagccaactgagtgaaggaagacggcagggaagctgtgccacatcctgggttcttgtgggaagaacgggaacaagctccccaccataagcagaaaccaaactcagaaaggcagagcagagcccagtgtgtggtggctcacacctgtaaccccagcactttgggacgccacagtgggaggattgcttgagcccgggagtttgagacaagcctgggcaacatagtgagaccttctcccctcttcaaaccgacagaaaaaaattaaccgggcagctggacgtggtggtgcaggtctgcagtcccagctactcttgaaggctgagctgggaggatcacttgagcccaggaggtcgaggttgcagtgagcagtaatcccgccactgcactctagcctgggtgacagata

SEQ ID NO: 82202 - DNA, 147 bp, Homo sapiens
aggccaaggagaatccagataggccttgctgggtttcttgcctgtttgcatcagagtgttttttgtccagtcattttttttgagacggagtctcgctctgtcgcccaggctggagtgcggtgacgcaatctcggctcactgcaagct

SEQ ID NO: 82203 - DNA, 162 bp, Homo sapiens
atatgtaacaaacctgcacgttgtgcacatgtaccctaaaacttaaaaaaacttaaaaaacacatagcccaaggggcaccttctatgtagcaaaggctaaaaaataaataagtagaaattaaaaaaagaaaaaaattagcccggtgtggtggcatgggcctg

SEQ ID NO: 82204 - DNA, 416 bp, Homo sapiens
cctggccgggtccagcattccagactggaaatcagagaggacaacatcctagatacagggaccagcactgaccaggagttcacagaaaggccatccctgcccctagacacactgttatatgtaaatgcttgttccccggtgctgcaaagaaatagcacttgaacataaatttaatcctctcagcaaggccttttgtactttctgcagaaagggtgctcatcgcagatggaataatggcgagagcacatccgaacaaaggagggaagcaatttttattcctcacgcagtttgtcccagctactgcgtcctgtctcccaaatttatttttggggggggccccaaaggggggggattggcaggagccagaccgcacaatctaaactaaaacctgattggctaacagtttaaaacttttc

SEQ ID NO: 82205 - DNA, 370 bp, Homo sapiens
tggcgggcgcctgtactcccagctacttgggaggctgaggcaggagaatctcttgaacctggaaggcagaggttgcagtgagctgagatcatgccactgcactccagcctgggcaacaagagtgagactccctctaaaacaaaacaaaacaaaacccacaagtgggctaatcacaaatatatttgaatatatgtacacccttaatactaccaattactacacactactaaagcaatctaggcagatcacaattcaagttcctaagaatgcgaccataaggaaaatggtcgggctgcaatgaaacaccttcacatcaataattagaatgctggatgacaaccccaacagtcgagacccaaactgacttggc

SEQ ID NO: 82206 - DNA, 773 bp, Homo sapiens
aagaaaaagtagacctccaaacaagcaatattacaacagacagctatttcataatgataaaatgtcaagtaattatgaagacataatgctgtattactgacagaataactaaagaaaattaagataaaataattttgacaacagcttgacctaatcgatattgaccaagacaatagaatatatgttctattatgctacacatgaaacatttatcaataggctatagaccacaaaatatctctcaagaagtttcaaaacactgtaatcataaaaagtatgctttctgaccataatgaaaatgagttgaaatgggtaaaaacaagctacccaggaaagtctacactattggaaattttaaatacaccttaaaatgccctttagctcaatgaagaaatcataagaaacacctttaaatacattgaactgaatacaaataaaaatatactatatcaaaatgtatgggataaagttaagcagacccagattaaattttttgtataaatgcttattctagaaaagagaagttcaaaacaagtgaactaattttctaccttaaaaagaaaatctaaaacaagagagcaaattaagtccaaaacaagtagaagaaaggaaataaaacagaaattagaaatcaatgagacagaaaacagaaacaggagaaaatcaacatggccaaaagttagttctgtgagaaagaaagaaaacgcaaattataaatatcagggattaatgagattgtacagttgtagacacaagagacattaacaagataa

SEQ ID NO: 82207 - DNA, 571 bp, Homo sapiens
ggagattgctgaagtcctcattgtgaatctgtgacttgggactggaatggaaaacacaaagcagatgtcagcttctgtgcatgaattttctcatacagagtagtgctaggataattttagaagagtagcgaaaaggcaacatatgattacagttcagatactgagggtgtttgagctagaaatagtccaagaaacaattataattttatattggtcaacacatgacctagctcaaagagagcttgatttgttaaatgtgtcccctaaggaaagatcactgaaccaattggagttggagtccctctcttctgactgaatcttaagggaaaagaagaaaagggaagcaagctcccccatttctgtcataacaggcattggggagaaggagagaaaccactgggaatggaaaattttctctgatctacaggagctttggagttgagttggggaagtggtgagttgaggataaaacaagctgactctgatatactcaagctggcccagaatttgttctatatcagtgtggcaaacaatacagcaaatcatttttgtattgacacatgtcccaaac

SEQ ID NO: 82208 - DNA, 167 bp, Homo sapiens
tttataaaggtagtttttgtgtctatttttgtaacacctactgatccttactaaaacatctgaatatctaagacctcctgtaacacagttgatcagtttgtttcaatcatcccagtagctaatgtgcattactttactgttacccaggctgtgataattagttataa

SEQ ID NO: 82209 - DNA, 392 bp, Homo sapiens
gtctgagcttcaggaaggcagggttaagccaaacacagatggcattgtgttgggcagtttctctgttctttcactgagaaagacttcctcctcacctcacctctctaaggaacagaatggcattggtaagaagaggattggatttagaagaaataaaagcagttgttcacacctgtgctgtgtgctgaggccctgccctccccatgatgtcattcctcagaacagcctaagttggaggaattactaaactcatcatgacatgaggaggcaggtttggagagcctaactgccccagaaaaataataatgaataataatcagtataatttattatgcacttaaggaccaggcttcatctgtcctataccgctgaatcctcccagcaaaccaatg

SEQ ID NO: 82210 - DNA, 193 bp, Homo sapiens
ggcacttaagacaatgttaaaagagtcaaaattaattgaaggaagaattattgcaatgtctcagtcagacttaagagttttcacaactcatttcaagctgtaataactcctgtcgataccctcttctcatccactaaggaatattaaatatgtaaatattgctcaagttctatttcaggactccttttagtgg

SEQ ID NO: 82211 - DNA, 399 bp, Homo sapiens
catctgctccctctcagcttccctaagtgctcatgactgagcaggacataaggcagggatgtgctcgctgttcacgacagatttccaaggagtgaaatcaaagactccttagaaatatttcttggcatcctccccaaaacataaatgctattgattgaagatttaatgactcaaatgaatgcaatggctctgactggctttcttgaatgtaccactgttattttttaaacccatgaataattaaatagttcatacccatagtatcgagatggacaaaggcagcaatctttttcaaatttcacgatcctttcaacaaacactgcattgactaaatcttagcccttccctgacccagggctctatcataaactaaagctcagggcactgcagaggaggccc

SEQ ID NO: 82212 - DNA, 266 bp, Homo sapiens
agccaaggtcacacatacatgactaagaggcagcacagagaacaaacccaggtcgggtctggctctaaggcccattttcttagctaggagggctcagtctgagcttcaccttgggcttcacttacaggccctgcttaaagagggggaaaggaaaaggagagaacgaccctcgtctctcaagcactatacaccctcattgtgacaacacgcccatgaaggaccctggccagtagggcccccactgatacaatctggtgattcccgag

SEQ ID NO: 82213 - DNA, 389 bp, Homo sapiens
tccccaagctgatctatagaggcaatacaactaaaggaaatccaaatcaactttttttgtaaaatctgacaagcagattcaaaaatatatatatgaaaaagcaaagggcatacaatagttaagacactcgtgaagaatactaaggtgaggggacttaccctaccagttatcaatacctaccataaagcatagttattaagatgttgtcatggccgggcatggtggctcacaactgtaatcccagcactttgggaggccgaggtaggccgatcacctgaggtcaagagttcaataccagcctgaccaatatggtgaaactctgtctctactaaaaatataaaaattagctgggcgtggcagcatatgcccgtaatcccagctacttggga

SEQ ID NO: 82214 - DNA, 412 bp, Homo sapiens
ggatgagttccttgaaagacacagaaactattaaagctctctcaagaagatatagataagctgattagccctatatctattttattgaatttaaatgtaaaaatcaatatttagttactggaaaacttttaagtgtggttggaaatggtatacgaactttttcaactgaattttatgaagtctaatcacaggtaaaggttttctgatgaaaatttagtgtctgaattgagatatactgtaaaaaatgttatatatcttaattatttcttcacattaattacatgttgaaataatactttgggtgtattgggttaaattaaatattatgaaaatcttgcctgttttctttttacttttgatgcgtcagctaggaaatataaaagtgtagctcacattctgtttctgttgacag

SEQ ID NO: 82215 - DNA, 379 bp, Homo sapiens
aaagtttaataaaaggtagggattatgtcatatttgtaattgagaaagtagtttcacttcttttaagcctgaggttttttcttttcactttacaaagttagaatttttttgtccattgttacaggcaaatattgggttgcttaagctatggcggtgcagtaaggagagtacagacttttaattagaaacaactgtgtttagattgtctctaatgaaacctgcgactttggcaagtaaattatttaacttgtgctattaaaatataatcctgggttcatactagaattttactaaatgtacatgtcatggtttagcagcatgcctacaaactgtactgaattaggtaagaacaaagacagaataaatgaaatttcaaagt

SEQ ID NO: 82216 - DNA, 411 bp, Homo sapiens
actgctcaagtcagacacctgggagtctggatccttacccccacatctaacatattactggcaagttctgttgattcatcctcagaaatatacctcaaacccattaacttctcttcatccccaatgccaccttagtccaagctagcagtctcccactgcgatgactacaaccacctactcttttagtctcctactcttgcctcttcccaaattattcttcacacagcagccacagtgatcttctaaaataaaaattcagagctctaaccatgagttgtaactatttctctctgtttatttgattatagtctagctcctgtaacccccataaggcagggactatgtttgtcatgttcactgctatatccccagagctgagcatagtataatacctgacacatagtaggggtt

SEQ ID NO: 82217 - DNA, 375 bp, Homo sapiens
aaatagtattttagctgtttctgacatgtaaggactttagaagtcatcactgtgtcctaacaagtaaaaagctgaacaaactgaaaaatcaacaaatcttagctccatcagagaggtgtgaggtcagaggacaaatcactgctctcaaaattggagaggtatgtgctgggattacaggaatgagccactgtacccagccaataatcccctttttaaaaagttatttatttatatttttagagatggggtctcactctattgctcagactagagtgcagtagcttgatcatgactcatggcagcttgagcccaggaagttgaggttgtagtgagctgtgattgcaccactgctctgcagcctgggcaacagagcaa

SEQ ID NO: 82218 - DNA, 400 bp, Homo sapiens
gatcgacctttgacctcccaggctcgagtgatcctcccaccacagcctcccaagtagctgggactacaggcatgtactaccacacctggctgatttttgtgttttgtacagacagggtttcaccatattgtccaggctggtcttgacctcctggtctcaagacatccacccaccttggcctcccaaagtgctgggattacaggaatgagccactgtacccagccaataatcccctttttaaaaagttatttatttatatttttagagatggggtctcactctattgctcagactagagtgcagtagcttgatcatgactcatggcagcttgagcccaggaagttgaggttgtagtgagctgtgattgcaccactgctctgcagcctgggcaacagagcaa

SEQ ID NO: 82219 - DNA, 1026 bp, Homo sapiens
acataaaattgccgttgataattggaacatctgaacacaacgtagaacttttacttatactttaacatgttgacatttcatcctctgcaaactgtcttggccttataagggcttactcattgagcaatagatcttggtggtttgccttggaaatagaagaccggtactaccccatcccaggcagaatgactggatccagaaggggtacaactaggaaatgcagaaagaggctttgttcctggaagatgctgttctggtctagttttaagtgctgtccacataagtgtgaaatgaaaatcaatcttggggcccccaaatcactaagctaaaggcaaaagtcaagctgggaactgcttagggcaaacctgattttattcaaagtcaccgctctgcttgcttatgagataaatctgtatcagattgcctcttttagagaggctcattagaaacgcaaaagaatgcaacctttcgtctctacctatgacctggaagccccctcccaccttccagttgtcccaccttcgcctggcattgtcccacctttccagatggaaccagtgtacatcttatacatattgattgatggctcgtgtgtccctaaaatgtataaaaccaagctgtgcccctaccaccttgggcacaggtggtcaggactcgcctgaggcggtgtcacagacgtgcatccgcagccttggcaaaattcactttcctaattaactgagacctttctctagatattcggggttcaaataaggatgaataagaagaggcagagtgggaacaatgcagtcttgggctaaggaggcttcttggaagctctgctaaagcggggtcttgcccttagctgcagtctagagccccctgggaagctttcaccagcctgggccccactctagatgttccgatttaattggtctggggtggggcccgggaagtggcacttttacggactcttcaggtgattctagtttatacctggggttaagaaccaccacattctagcctcaccatttgctggtttcagaa

SEQ ID NO: 82220 - DNA, 306 bp, Homo sapiens
catatttctaggaatttgtgcatttcatctgttttctagtttgttggtatattgttgttcatagtattcctttataattcactgtatttctatgaggttggtagtaatgtcccttcttttatttcttattttagtaacttgactcttccctctttatgcttgtgtcttaagtctcagttttcttttctataaaatgggtatagtaaaatctgccttgcagagttattgacattgtcagtaatcaccttggatcttgttaaaaagcagattcagtgggtttgccatttctatcaagtgtccaggtaa

SEQ ID NO: 82221 - DNA, 409 bp, Homo sapiens
cctctcttctttgctgttttgcatattcctctgtaagacattctcatgtgagaaagatcatacattaacaatataaggtgtctgttgctttaatagaatactgagaaatgaaagataaatgtcagattgtcatttgatggtgtactctatcccaggattaattaatgcattactgtgcttatgcaatacctatttggatgtactgtctgggaagaatatgattaacatgatgcaaacatccccccgtctaaaacctgtaggttttaagttatctgggacaggctaccatttgctctaagcaaagacacacatttgctatagctgtaaactgtcttgagggccaggaaatatcaaacctgatagattgtttcaaactaactcaatcctggaaaaaggtcagtctgcaaaa

SEQ ID NO: 82222 - DNA, 340 bp, Homo sapiens
aacaccagagaaactggttcctgcaggagaaactggggtggctggtggccctactgcactcaggagggctcagggctggtgctggtcccctggagatgctgtgctgtctcaaactcacttctccttcttcctcctctctttgaactcacccgggcctcatttctccccattgggatgcagccaccaacagccccagttagaaattccagtcaaatgagacctctgtctccttgggcctctgaatcagtcccagggaaggcggctgattggccttgtttgagtcacgcactctccctctgatggacatctgttattgccacgggaaactggctctgggcat

SEQ ID NO: 82223 - DNA, 303 bp, Homo sapiens
tccagaacggtgagaaataaattgctgttgtttataaagtaacctgtttatgttatttttttatagaagcctgatcagaataagacaatattggatagaatattcaggaatgtcttgcctccaatgttggcccccctgtactgagctctaatctacactcacctaaaaaattataaaatcataataaaactgaaaaagtcaaactctcaattgcatcccagcacaaatatcacagatgtttatttaaaaaattatgtcaagcccctaaaaagctaaaatccacagttctgctaatatttctct

SEQ ID NO: 82224 - DNA, 208 bp, Homo sapiens
agaggataaaagtgaacataggtatcaatttatatataaagagggaagcatgaatctgacttggtactcactctatgagcagcacggaaacaggtatagggatttatcagcttcatatcagctgaccaccacaagaacccataaatggaagatacatgttgttttagacacttgcaagggaggataagtgaaagagaggcctgagcaa

SEQ ID NO: 82225 - DNA, 402 bp, Homo sapiens
tattatggctactgggtacaaagctcatggagtgcatttgatcgaccacagcatggacatggaattttacatggctctggccatagtgccccagactgaaagaagagtttaccatcaataaacccactggaagaggcctgaagaatggcacacagcacagagaggtccgtcctgcttttacatctgtaggaatgtcttctcagcagcctctcctgcatgacttcagatttcgtaggatctgaacacttactaggcttggggatggtaatgtcatcagggttttactagaggttggagtgcttgttttctcccttccttattttagttccctggtattattcatgcattaattggtctcctccatggtaacttccttggaaagctggaaatgtgaatttctat

SEQ ID NO: 82226 - DNA, 341 bp, Homo sapiens
gtccaataggcatccccaacttaagacggccaaccctgaactcctaatcatcttccccaaaatctgcttccctcaccaagatgctttatctcatctcaataaatgacaactgtgtcctttcatttgctcagactgaaatccttgactccagtcttcttctcataacctgtatctggcccaccagcaattgccgtcagccctatcttaataatatttccagaatctacacacttcacatcatcttcaccactattactttggcccaagttcccattatttgctgtctggaatatattaatagcctcttaactagacttactgcatctgttttttcctgtttt

SEQ ID NO: 82227 - DNA, 748 bp, Homo sapiens
cgaggcgctcccttctggacactcagagaaacgggggcatttctcattttgtgttttcacattttataattatctgtatttttcttttccatctagaccaccagctctaagagggcaagggatgtgtattagtcagagttctacagagaaacagaactaataggataaatgtacatatgaaagggagtttattagggagaactggctcacacgatcacgaggtgaagtcctaccatacgccatctgcaagctggggaagaaggaagccagtaatggctcagtctgagtccagaaacctcaaaaacaggaaagtcgacagtgcagccttcagtctgtgacccaaggcccgagagcccctggcaaaccactgatataagtccaagagtccaaaggcggaagaacctggattgtgatgtccaagggcaggaagcatccagcacgggagaaagatggaggctggaagactcagcaagtcggcttatcccaccttcttccagtatgacaggctgataggctgtgtcacagtcagctgtaactcagtatgataggctgtgtcacagtcagctgtgactcagtatgataggctgtgtcacagtcagctgtgactcagtatgataggctgtgtcacagtcagctgtgactcagtatgataggctgtgtcacagtcagctgtatacactgaactgaacacctgctattctggcaggcactgtgcgcaatttgtgtctacgtatttcatctaatccta

SEQ ID NO: 82228 - DNA, 812 bp, Homo sapiens
gtctggagaggcgaggccgcagcccagggctggaggtggggttgggggaactcggcccggggcccccagaggtaggtggcagtgggtgggggactggggagcagccaggccctcccagggacctgaatgggaagggggctggtggcttgggggctggggacggtccagaaagatttgaagctgggccgacacagcccttgatgtggggaatgtcctagaaaggaggaagccacgggggcagggagcacggggactcggaggccttggggtccaaggggagccgaggggagctgtcaaggcccacagtggctgaaccatgaggagctgctccccagcaaggccggctgcagggcttggtgggcctgggctgggcggaaggctcctcccagcgtgggggctgctgtggggacagcaaggaggggtgcagcgagggcctggagaaggctcaggtgcagaccctcagccgtggggcctcctccagtcgccccacagcctgggcctggcacccccccaccaagccagaggggccgaatgccagggcacctcagctacacaaaggctcggacccctagcaggacctgggcaccgcggctgactggctgcctgacggagaatggagcctctctgtcacctgggccaacatgaatgacccttcgtctggtgtctctggggttctggctggagagccaaaggctggaaggtctggacccgctgctcactggggtctggatgccaccgtggagctgcctctggcgcagcgggagaacaagcagagccaccctggtcgtggggacggcacccgtgtggccggg

SEQ ID NO: 82229 - DNA, 435 bp, Homo sapiens
aactcctatctccagcccagacctctcctctcagctccagatctgtgaatctaactgccaacctgactttgcctctcagattccccaaaggcatctcaaactcagcatgtccaaaagtgagctcacaatctctacgctcaaattggcctcttcaagcatctgccaccttgaaagaaataatccactatccagaaggtccaacagccaggaacttaggagtcatccttgtccctcacccacatcgaaccaatcactgaggcctgttgactatacccgtctaaacagctcttgaatccacgcactcttcttcagctccattgttgcccaagatactctcattactggccaggactacagcaagagcctcctaactgagctgctcacatccacctccacccacttaacagtcccctccatgaaatagccaaagtgagc

SEQ ID NO: 82230 - DNA, 723 bp, Homo sapiens
agatgagaaaatggaggcagagtggttaagtaatttgcttaagatcacccagctagtaagtgacagagctggtatttgaacctaggcattctagcttcagcagttgagctttttttttctttaggttggtatcaagttaacttaaatatgcgtagtggcaatttgtatttcttgtttgtttgactatatcctggttcatgtttgtttgtcaggatggttaaatgtatatccatattgtagtagaattttttttgattatttaaaaaaatgtttaggggctgagtttttcatcacaaccctctccttcctctcagaaatagtaactggtgcatgggctgtggtgagggagcctgctgtgccatgtcagtcaaatctgggctgtcttcatgattcaacttggtgatgtgatgcaaccttgggcctgggttgaatggacagactgacattagaatctacactgagcacaccttaaaggggtgtgtgtgtgtttaatgtagatgtacgtataaggctcatttctgactttgattactgacatgagcagttgattagccgtagtaaatattaaattcatagtctggatataatttttaaaaaatagcaagacatcaccccccccccaaaaaaaaaacttaacagtcaatgtctttcctgaataaaattaataaaatttgaaacaataaataataaaaataggaagtagcaaactacacaaaaaaaaaa

SEQ ID NO: 82231 - DNA, 352 bp, Homo sapiens
ttgcagttttcagcatctacatcagcctttagggtgaagatgctgcatctccagcaggcccttatgacaatgccaagctgtccttagatgtcaaggcagtttcatggtgtcctggacatctcagcctttcccctttactgctctctagtccactttctctgcgatgatgttaggacaacatattctagggcagctatttcgagggagaaaatacttgtctagagtctaaggactcacagagagcaagccacatatgagtggataagctgccagcacacagctcaagcccagctctgtggccactgatagatgtgtgatcttgaccaagtccttcaccttctttgagcttagt

SEQ ID NO: 82232 - DNA, 756 bp, Homo sapiens
  misc_feature (670)..(670): n is a, c, g, or t
agcggaataagtacacattttattttaaactgttaaaaaaaatattgcgtcacatttttatgtcaatctaacattaaaagtagactgaaaaaagtaaattatccctagttttcagtctcttaaaagatacctgagaactaaaaaaaaaaaaaaaggaaatacgagcaagcaatatataaaaaagcaaaaaataataaaaattactagaatccgagagtattagcaggtggcagaaaacagatgatcctaattggtaaagaatttgtacatggaggcattttaagattaaaggaggaactacaaaggcaccaagttacacagaacgtagtttggtgagatactccaacagctgccagggaggcttgaatccatcaaaacctaagatgaagaaaataggtgttaggtttaagaaaacgtcatcatatgtaactaacctgcacatggtgcacattgtaccctaaatcttaaagtataataataataaaaaaagaaaatggtcatcaatagtaaatgaatagtggtttaaaaatactctttttggtcaggcgctgggattacaggcgtgagccaccgacccagccttcattcactttctttaaatgcctccaagttgattattctcctagctcatatctccttgatgtgcatgagggagcctgggtctaatttngggggctgaaaaggtaagaaggtgaggtcagttttcccaggagtcctaaaaaatctggtaccttacattgagggtgtggaaaaaag

SEQ ID NO: 82233 - DNA, 789 bp, Homo sapiens
cggggagccaggggcatgctggggaagagcattccagcagagacatggacacgtgcgaaggccccgaggtagggacgagctttgggaacacgaggcatgtcaggaaggccggggccccgagggagtgaagaccaggcgagtgggagggcctgagcttgttccaagtggccctggaggacttcagcccacacaccctgagagaagaggaagggagctcacactggctatgggctgcccttgccaggagtttggtacaatctggaggcagcagagactcagaggttcagcaacttacctaacaacacacagtggggctgggggcagcgcagcccacctccagggtaagctcatcgctggatgctgttgccaggtaggcctcagcgcattctacccactagatctgagttgtcttggttggggaggggggcataattaagactgaaggaagaggcagtccctaaggtcctggatcccagccctagccagggagctgttgtacacacagctcagagacaaagaccatccagagtgaagaggccaactgttaactgggttgcttgtgtgattggacagactcaggttgtcagctccccagccctgccctgagaaggcagtctcatgactgtctctgcactcccatccccaacaggccccacagctaaaaaccacccctgaggtggggtgggcattggcagggccagggcttcacctggagctcaatgtggcagtgcctgccggagccttctaatgggtggtgcctgcaggcctctagccatgtggggctcctgg

SEQ ID NO: 82234 - DNA, 491 bp, Homo sapiens
gtaaaacacttaaaagatggtctgtttactctttctctgttgcctggaagaggtggattaacaacggctgggttcagtggctcacacctgtaatcccaacactttgggaggccaaggtgggaggatcacttgagctcaggagttcaagaccagcctgggcaacatagcgagacctcgtctctaataaaagtaattaaaaatcagccgagtatggtggtgcatacctgtagtcttacctgcctgagagactgagatggaaggattacttgagccctgcaggtcgaggctgtaagtgagctgtgatggtaccactgtgctccagcctgggcaacagaacgagaccctgtctcaaaaaaaaaaaaaaaaaaaaaaggaatggtattatttctgacttaaatgctttgtagaatcagctgtgaaatcagctaggccccatagttgtctttgtaggaaagtttcaaattttagtaagttgtatttttctagaaatt

SEQ ID NO: 82235 - DNA, 379 bp, Homo sapiens
ttattttttctttcacctcctgatactgaataatctcagttaacctgtctttaagttcactgactattctgcctgcttgaatctgctattgaaatcctctagtgatttttttattaaaaaaaaaaaatggagacacagaagctgggcagcctccatggggcttccacacactggggcttgcttccggcccccagcgactccaaggggatgagtgaatttaactggcaaggagcaatctgctgtcaccctgggcctctggaatcctggcaggaagaggccccacgaccaccacggacactcgagttgcagggaaagctgcttagagaagtggtggggcagcaagccagctgatgtggagcccagagggtttggtgcagga

SEQ ID NO: 82236 - DNA, 609 bp, Homo sapiens
aacacaaagaaaataagttatttgaaaaaatagcaaattatgtaattttgagcttttctatgtaattcatcaatatttaaaaaattacaaactcttaaatgttagattcatattttagtttgacttcagtatggagcatacagtgatgttatataaatgtagatgcttttaaaatgctggtctaattctaagaatgattaaattatttcttcatgtgaaagattatggtcttaattacaattaaattataaacatgatttattctggtgaggactgaccattgactttcttattcagcaaaatgattatcattgctatttacctttcagaattacattacaagaaaaaaaagtaaggagattgaactcttcaaaccgatccaacagtaaagccttttaaaaaaattcatccttggaagtaattcataactaacaggtgtgatctccaacctctggaagaccctaaaataattacagatgcaccctgggatttcctagaatttgtgctggactggcttccaaaactactcatcattgtcatccaaacaaagcagtgagcagctggaagttgttggtattgtactaaataaatctaaagaaaattagaaca

SEQ ID NO: 82237 - DNA, 278 bp, Homo sapiens
cttcattatatccctttctgaaggcctgtgacttccttggagtccacaagaaagcccagtatgctggctgggcgcggtggctcacgcctgtaatcccagtactttgggaggccgaggcaggcggatcatgaggtcaggagatcgagaccatcctgactaacacagtgaaaccccatctctaataaaaatacaaaaaaattagtccggcgtggtggtgggcacctgtagtcccagctactcgggaggctgaggcaggagaatggtgtgaacccgggaag

SEQ ID NO: 82238 - DNA, 574 bp, Homo sapiens
ctttgggcctcagggcgcctagaaggcgaggacgcagacctgaaggcggccggtgagcggggcgggttctgctgggtcgggaagaaaaataattctgcaaggtattttgttttttattaattcgcgcttggccacctcatctgtaaagagattctaaaagcaagatctggaaaagtgcttcgtagactccttgacggagtttgcctcctttgtacgctgcgtgaacatgcctcacctttaagagagtcttaaaggtaaagacacgaaaacacttcctccagggaccttcccgaaaacgttctggctctcatctggtgcggcatgtgtccactttgcctttaaggagttcttaaaggcaagggcctggaagtgctgttcctgagatggattctcttgacttaccagtccaccacggcacttcccctttaaggttattaaaggtaaggggtggacagactttctgcattcagataatgagcagtggcaaccccttttggccagggccaggggggcaccagcaaggggccaccctttcccttttcaataaataatttttgtactgcctctgttcaaa

SEQ ID NO: 82239 - DNA, 123 bp, Homo sapiens
tcatcattaagatgtcagtactactcaaagtaatctacagattctgcataatccttatcaaaattccaacagcattttcatatgaaattgcaaggggccccgaatagccaaaagaatcttgaa

SEQ ID NO: 82240 - DNA, 316 bp, Homo sapiens
tagtagcactaaagccccgttttggtcacactctcacctaggtgagaacctgaccaaaaatgtggaattattaaacaaaatgatgggaagccaatgttctgaaactgagctcttgcactaggcccccacagaccaaattaaaatggagtcactagtgctaaatgctttggagtcaaacagaaatgttaaagaagatagatcccaaaacagagcagtgttttatttttctccagaaaacaggagattccagcataataagaaagtctcctctgttgtaacccttacaaaaaagtaacctgaagtaaccatttttttt

SEQ ID NO: 82241 - DNA, 952 bp, Homo sapiens
caggcatcacacttcatacaactatgtccaagatggaaaaaaaaaagtagttttcttctcacatagttcttttcatcgggaaggaaagcatttcaaaacctccttatcaaacttctatggggccatttctcagaatcaggtcacatgtcctggctgcaaggactgagaaaatgagtagatggtattttaatcctctatagtaagagatggttttggtagcaagaaagtgatattttggaatgttatactttgtggtaagaaaccagtggtgtttaccacaattaactctttaaatttaccttctggtcttgagctccagactcatataaccagttgctactggaaatttccactaggaagacccactgatgccttaaattcaatgtatctgccctttctccctgcccctggctcttctccatactccatttcagggaacagcaccaccatctatgcagtggtcaagccaagaacctcggtgtcatctttgcctcctctctttcttatcctttttcatcaccttatatgattgcctccatcacctaaaggcccctcacatccgcccatttctctccatctttatgtcctcattgtctctattctgtattgtccatttctgaaccacaaaacagtgcttaactcagagcagtaagtcagtttgtgggatgaatgtttccaaatgggaaacaaacattttaaggtaaacaatgactaccatcttgccttatcaattagcctcttttcacccattttttgttgggtgggtggaaggccagatgcagcaggatgggttattgacagaagagaattataaaggatataaagtattttaactctctgtctgtcctatactagcctatgcctctctccttgtgctctcctcatattaagaaacagaggatgttgtccgggaggtcataataacctaagtgagtaaaattctgaaagccaa

SEQ ID NO: 82242 - DNA, 379 bp, Homo sapiens
acagtggcacagtcactgcttactgcaaccttgacctcctgggctcaggtgatcagaaagttttaaagtggaaaaatcatcagactggataattcctaggaaataatttggtatacagttttcttctcccactttccagttctgcaccttttgtgtaaatccatagatcacagtgtaggttttcagatggttgtcccagctcagtgaatttatggctaaatttgttccattacattcatagtctcctgattcacttggttaaactgataagcattgccctacattctgtggcttctttgtttacttgttgtcctctgttgttacttgacccatcttagtaatcttcctttaattccttccagaaggggaaatgtggtgg

SEQ ID NO: 82243 - DNA, 491 bp, Homo sapiens
tagaataaaactggaaaccaactccaaaaggaaccttcaaaaccatgcgaatacatggaaattaaataatctgctcctgaataatcgttgagtcaacaatgatatcaaaatggaaatttaaaaattcttcaaactgaacaataacagtgacacaacctatcaacacctctgggatacagcaaaggcggttgatatggtttggctgtgaccccacccaaatctcaacttgaattttatctcccagaattctcacgtgttttgggagggacccagggttaggtaatcgaatcatgggggccagtctttcccgtgctattctcatgatagtgaataagtctcacaagatctgatgggtttatcaggggctcctgcgtttgcttcttcctcatttttctcttgccactgccatgtaagaagtgcctttcacctcccaaggcctccccagccatgtggaactgtgtaagtccaattaaacctctttttgttcccgg

SEQ ID NO: 82244 - DNA, 269 bp, Homo sapiens
ggccaccagctctctgtgctcacatgaactctttttttgtaagcaggagagagtgaactctggtttctcttcctcttcttttaatgatactagttctattggatgaggaatccacccttatgatgccatttcacctcaattacttccataaaggacctacctccaaatacagtaacattgggagttagggctttaacatattaatttggggggaacacacacattcagttcatagccactagtatcagccttttaactgggaagttgct

SEQ ID NO: 82245 - DNA, 503 bp, Homo sapiens
tgattataatggattgaggtaaaccctatacagatagaaggaacatcagtgtggcccatgccaatctaagctgtatgtggataaagttcgctaccaaaattaaacttaacagaagggagaacctggatttgaaccagggacctcttgctctacagtcaaaaagctctagccctgagctatacccccatggcacactgaggttacctagttaatacctttcatcagtgtgggagcactcagctttgtaaaattaaataatggcttccctctaggactgactttctggaagctgccagacctgattcacagctagacaccttccctcagctctgcagctcaccagtcctgtctctggtggagccgtgaacaggagaaaaggatggaggctgcctgtggaacccccagccatttcccattgttttttggggttaacccaagagccggccactggtctccaaaacagtccacagattccaatctgacctcccagcccaaattccttt

SEQ ID NO: 82246 - DNA, 694 bp, Homo sapiens
atagcacgttacagtttgcaacagattttcacttccattggacccttgctccttggaacagccctgagatgtgggctgcacagaaacccgcattgcgtgtttgaggaaactgaagcccacagagattaagtgacttaagtacacagagcagagccgagacttgaactcggctttgccgatggccagcactgggctacttgtgagttaatatttaatcacatacaggttgaggagccgttatccgaaatatttgaaaccagaaaagttttggatttcggactctttcagatttggagatatttacagaatacctgccagttgaacatccccaacccaaaactctaaaatctgagatgctccaatgagcatttgctttgagcatcatgttggtgttcaaaatgttccagattttgggtttcagatttttgaaatccaacctgtgataattaattttaatgactgcggctgctactcttataatcaccactgctacaactgccaccaccaccactgctaccactgtagaaccaatggcagcagcaaggtctggtcctgtgtgggccccttgatagcagacctcaccccagatggagacgccattacccaaagagagaaaggggcttggtcaaggtctccaagcaagtctaccccaggctgggaggaggaccacaaggatcactaggccaccagctgg

SEQ ID NO: 82247 - DNA, 984 bp, Homo sapiens
gttcagatgatgaaacctgatcaacataccacagaacacgactggctgaacaggttgtgtagttcggcacagagtagctgtattctcaaggctgttaaagcaagggtctgacaccactaagtgttagtagtgggttgatatctattatggaaatggatatgtaaagcagccaaaacccgatggcatgaaatagttacatagtcaacctctcttgagatctaattcatattccactcaccaataaactctgatacttggacttcccatatagcttgtctagacccttgctgtttaaagtggggtccatgggccaggagcactggcatcacctgggaacttgttagaaatggagactctcagaccccactccagcaagcctagcatgttgggtttgcctgatgatgtggcatcctgtttttctatatcatactcatttctattagtgtgagtcagcatccatgagtttgattaacgtcaagacactgatgaagtcattgctgagcttgtgaggctgagagccgaccctgggcagaggtgaatttatcaagagaatatccctaaaggggtggcccattggctgccttcaggtgacctcccttcttgtggggtgtactttaattttagcattgagacccactacaaattgcctcagataacagcagggggctcatttccattctggcatgtgcactccagtgaactccccttgttcccagatgcatgaacatgcttcctcaagctgcttttcagccagcctggacttcagcagtttgtgagagtctttgcaaatggtgaagaaagagtcttgttgaaatcctattcggtacatctgtctatgaattattataactttttttcaggctgggtaccgtggctcacaaccataatcccagtactatgggaggctgaaggtggaggattgcttcagtccagaagtttgagactggcctgagcaacatgcaaaaccccatctctaaaaaaaaa

SEQ ID NO: 82248 - DNA, 776 bp, Homo sapiens
cgcatgctgcatgctacaacatggatgaatcttgaaaacatgctaagtggaagaagccagacacagaagactctatgtactatgattccattcatatgaaagtccagcagagggagctctctagtgacagaaagtacattagcggttgctcaggactggagggtggaggggatggggaaggcagtaacagctaaaaggtacaaggtttctttctgaggtcacgaaaatgttctaaaattgtgctgatggatgcctgtatctgtgaatatgcttaaaaccaataaattgtacactttgggtgaaaaaaaaaaaaaaaaaaaaaaaaaaaaaaaaaaaaaaaaacaaaaaaaaaaaaaaaaaaaaaaaaaaaaaaaaacacaaaaaaaacaaacaaaaaaaacaaacaaaataaaggcggcccccacaaacaaaacagcaagaggaagcaggcgaagcagcagagcgagaggcccgccggcggagggggtagaagagaggaggaggggggccctcgacgagggggagaggagagggagacgcaggcgaatggggaggggggggcgaggaagaagacgggcagcagggggaaaaggaagagaggagagcagaagggagaagagtaccagtgtaaggggtgcgcggcagagcaaaaagggggaggaggggggggggacgagagatgtcggggagggcgaaggagagccaagcgcggtatgtggaaggggggaaagtgggactgagaacgtagcgggacagcatgggtgaagggcggaggg

SEQ ID NO: 82249 - DNA, 889 bp, Homo sapiens
tctgatatctagtgccattactaaatagtggaagtcttcatttttaatctagagaacacagtctaagaaggaagttgaggattgtagaagataattttttgtttgtttgagacggagtcttgctttgtcgcccaggctggagtgcaatggcgcaatctctgctcactgcaacctccgcctgccgggttcatgcagttctcctgcctcggcctcccaagtagctggtactacaggcgcgctccaccatgctcagctaattttttgtatttttagtagagacgggtttcaccatgctggccaggctggtttcgaactcctgaccttgtgatccgcctgcctcggcctcccaaagcgctggattacaggcgtcagccaccgtgcccggcctgtagaagatgcacatgtaagaaaaatctgattaggtaagaaaaaataaaaagacaaaacaagcctgccacccagagacgtacaacaaaatgcgaactgtagttatttttctagacctttggatagccattaatatggttccacgttaataacagtggaaccatactgtatgttctgtttgtgttttcagtggaaaaacattacagaaatactctgaacaaccttctgtcaagtaaatttttcgagaacttatatgattatagatctgaactaatttatttaatcaatctgttatttgccttcctttttattttctagtttctggcttttataaatattgaaaatatcctcataggtcagtctttgagtgttcttattttcttgggataaagtgaattgctgagtcaaaagaatttgctcattttcaatgcatttgatacatactaccacattgctttcagaaaagttatgctagttttcccaaccagtgtttgatgggcaa

SEQ ID NO: 82250 - DNA, 434 bp, Homo sapiens
tgattcaaaaggaattattaagtaaataacactagctatggcaaagggaaatggtaaaatcatgaaggtaaactgcaaatgactaggtttgggatggttgtgaagcacctggagtctggaagagccgggttcaaattctaattccactagctgtgctgcagaaactctctgaggctccattatctcatctgggaaatggggactgtggtctcaaccacctgagaggctggctctgagaattgtcacacatacacacacagcgaacactcacaaaatgatcccattttctttgtctccctgctcagtgttcctttcctaaccccatgatgcttccctttcctgcctctgacatggtcacattcagcaaaaacaccttaggggttgggtgtggtggtttatgcctgtaatcccggcactttgggaggccaagacag

SEQ ID NO: 82251 - DNA, 348 bp, Homo sapiens
cagatgtcttggtagtcgcggctctggcgctccgcaccctccgtctgcggcagcgggggctggcggccccggcccctgcccggccccgtcctccaacctcatgcctcagccctaataccgccgccctcccctgcggggggcctttctccgtgtcccccgcccgccccgtccacttcgggcgccatgaacgaccagtaccaccgggcagcccgggatggctacctggagctcctcaaggaggccacccgaaaggagctgaatgcccccgacgaggatggcatgacccccactctctgggctgcctaccatggcaacctcgagtcgctgcgtctcattgtgagccgcggg

SEQ ID NO: 82252 - DNA, 264 bp, Homo sapiens
ctgtttttaaattttttattcaaattctaaaattatctgaagagctggaattaagtttatcaagcaagtaagacaaagaatctcttaaagatgacttctttagctttagaagtaatcttaaggattattactcatttggatgggtttgtgaggaaagataaagcagcacctctggagatttctcagtgaaagatggattctcattgttgagggaagagatttgtgtggcctccctttatgtctattaccttaaagatggtgaat

SEQ ID NO: 82253 - DNA, 3512 bp, Homo sapiens
agcaggaggagccgggcgcgcctgccacgcaaaactaccgggctggcagggcggcgggcgcggtgcgcgatcccgggtggcggcggcaacggcggtggtgacggcggcgactgcagcggccggctctcacctctcccctgtgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttccgtgagagtcatctcaaacactgcttaaggaaaagagaaacactaatggccaagtgtacatttgatttgatatacagacctccagattattttctatatttggattcacagcctttgcgctctgggttttgggatttgggtgtggggtaagttgaagggaaatcaatttaaaggaaagttctattatctgggttttagaaattctataagagacaaagtttggaagtacataaagtaataactgttagaattaggtaatggatatgaaagagaaaatgctttctcatgcatagacaagtgttttgggtttttaaaaaaaatattctgtcattggttacaaatttttactcaggctttctattggcatggatttcctttgacctctcacttttttataaattataatgcatctaaaccacctgtccccagttaatgtgccaaaatgtcaatttttaacttatctccagccaatttcaaagaaaacagaccagcatagttctgcaataacagttttaagatgggcatagggtttggaagaaagggagaaggattcttttttcaatgtactgtattgggacgctggtaactgttaacccagtgttcagcatagagctatatatatatatatatgtatatatttattattttcatataatttgccagacagagatcagaattgaaccgtcaatgtgaaataaagagttctccttgtacttgaataataaccacgattccaacccaggtctgctttggggcttatcagaactcctttctaaggagcactagaatgagaaatcatgttgttcgatcgtttcacatctgtatatcagctctaaagcagagatgtattatggtgatactccaaggtggcatagccattcatttacaacttccagatttgagctgcctggagggaatccatatcagctctgcataagattatatacaaagctgtcactcacaaaaggctggatgtgctttcatccaactggaaggctttattcttccaagttcattcatactcaaagaggccagtactttgccatccttgcacttctgttatcagggcccaaataacagtggcaagctaccaactaagttgtattttaataaagattccatgggttgaacaagccacgttgcagaaaaagagcttcccctaacctgggttgttgcagagtaaatcccacgacataagctggtatcagtggttcgggggaaatagttccattctatgactcttgtctcctcctccaggaggactgttctaactagtaatcttggccctattcattacatcctctgcttgtcattctgctaatttatgaagatagtttattatagtctgtacttcagttctcatcttgtaaataatgcttaacataaacttgtacttacactgaaatccaaaatagtcatgtttctgcagtattctgtagccaacttaaacctgtgctttcatgtttaagaaatgagaaattgtgccaaagatagcagaagagtagataagtgctcagtattgacgacctacatctgaaatctacaacataatgatactgaattgttatgtaaacatcataaatagtaaataatgattcaatgtgaattttaaaatgcaaatattgctattgtttataggaaataaatctaaatat

SEQ ID NO: 82254 - DNA, 3591 bp, Homo sapiens
agcaggaggagccgggcgcgcctgccacgcaaaactaccgggctggcagggcggcgggcgcggtgcgcgatcccgggtggcggcggcaacggcggtggtgacggcggcgactgcagcggccggctctcacctctcccctgtgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttccgtgagagtcatctcaaacactgcttaaggaaaagagaaacactaatggccaagtgtacatttgatttgatatacagacctccagattattttctatatttggattcacagcctttgcgctctgggttttgggatttgggtgtggggtaagttgaagggaaatcaatttaaaggaaagttctattatctgggttttagaaattctataagagacaaagtttggaagtacataaagtaataactgttagaattaggtaatggatatgaaagagaaaatgctttctcatgcatagacaagtgttttgggtttttaaaaaaaatattctgtcattggttacaaatttttactcaggctttctattggcatggatttcctttgacctctcacttttttataaattataatgcatctaaaccacctgtccccagttaatgtgccaaaatgtcaatttttaacttatctccagccaatttcaaagaaaacagaccagcatagttctgcaataacagttttaagatgggcatagggtttggaagaaagggagaaggattcttttttcaatgtactgtattgggacgctggtaactgttaacccagtgttcagcatagagctatatatatatatatatgtatatatttattattttcatataatttgccagacagagatcagaattgaaccgtcaatgtgaaataaagagttctccttgtacttgaataataaccacgattccaacccaggtctgctttggggcttatcagaactcctttctaaggagcactagaatgagaaatcatgttgttcgatcgtttcacatctgtatatcagctctaaagcagagatgtattatggtgatactccaaggtggcatagccattcatttacaacttccagatttgagctgcctggagggaatccatatcagctctgcataagattatatacaaagctgtcactcacaaaaggctggatgtgctttcatccaactggaaggctttattcttccaagttcattcatactcaaagaggccagtactttgccatccttgcacttctgttatcagggcccaaataacagtggcaagctaccaactaagttgtattttaataaagattccatgggttgaacaagccacgttgcagaaaaagagcttcccctaacctgggttgttgcagagtaaatcccacgacataagctggtatcagtggttcgggggaaatagttccattctatgactcttgtctcctcctccaggaggactgttctaactagtaatcttggccctattcattacatcctctgcttgtcattctgctaatttatgaagatagtttattatagtctgtacttcagttctcatcttgtaaataatgcttaacataaacttgtacttacactgaaatccaaaatagtcatgtttctgcagtattctgtagccaacttaaacctgtgctttcatgtttaagaaatgagaaattgtgccaaagatagcagaagagtagataagtgctcagtattgacgacctacatctgaaatctacaacataatgatactgaattgttatgtaaacatcataaatagtaaataatgattcaatgtgaattttaaaatgcaaatattgctattgtttataggaaataaatctaaatataaatgaaattgaatcagtaatttatcttgggctaaatggttctaccccttactaggttgccccaattagtggcactagttggcagagctgttcatgagctgccagttatcattttggagtcagtttgaaaccagcctcttaacacactgctgttaactcataaaagagaagagtgttccatttcagtctcaataaacacttccctcattctttc

SEQ ID NO: 82255 - DNA, 3726 bp, Homo sapiens
agcaggaggagccgggcgcgcctgccacgcaaaactaccgggctggcagggcggcgggcgcggtgcgcgatcccgggtggcggcggcaacggcggtggtgacggcggcgactgcagcggccggctctcacctctcccctgtgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttccgtgagagtcatctcaaacactgcttaaggaaaagagaaacactaatggccaagtgtacatttgatttgatatacagacctccagattattttctatatttggattcacagcctttgcgctctgggttttgggatttgggtgtggggtaagttgaagggaaatcaatttaaaggaaagttctattatctgggttttagaaattctataagagacaaagtttggaagtacataaagtaataactgttagaattaggtaatggatatgaaagagaaaatgctttctcatgcatagacaagtgttttgggtttttaaaaaaaatattctgtcattggttacaaatttttactcaggctttctattggcatggatttcctttgacctctcacttttttataaattataatgcatctaaaccacctgtccccagttaatgtgccaaaatgtcaatttttaacttatctccagccaatttcaaagaaaacagaccagcatagttctgcaataacagttttaagatgggcatagggtttggaagaaagggagaaggattcttttttcaatgtactgtattgggacgctggtaactgttaacccagtgttcagcatagagctatatatatatatatatgtatatatttattattttcatataatttgccagacagagatcagaattgaaccgtcaatgtgaaataaagagttctccttgtacttgaataataaccacgattccaacccaggtctgctttggggcttatcagaactcctttctaaggagcactagaatgagaaatcatgttgttcgatcgtttcacatctgtatatcagctctaaagcagagatgtattatggtgatactccaaggtggcatagccattcatttacaacttccagatttgagctgcctggagggaatccatatcagctctgcataagattatatacaaagctgtcactcacaaaaggctggatgtgctttcatccaactggaaggctttattcttccaagttcattcatactcaaagaggccagtactttgccatccttgcacttctgttatcagggcccaaataacagtggcaagctaccaactaagttgtattttaataaagattccatgggttgaacaagccacgttgcagaaaaagagcttcccctaacctgggttgttgcagagtaaatcccacgacataagctggtatcagtggttcgggggaaatagttccattctatgactcttgtctcctcctccaggaggactgttctaactagtaatcttggccctattcattacatcctctgcttgtcattctgctaatttatgaagatagtttattatagtctgtacttcagttctcatcttgtaaataatgcttaacataaacttgtacttacactgaaatccaaaatagtcatgtttctgcagtattctgtagccaacttaaacctgtgctttcatgtttaagaaatgagaaattgtgccaaagatagcagaagagtagataagtgctcagtattgacgacctacatctgaaatctacaacataatgatactgaattgttatgtaaacatcataaatagtaaataatgattcaatgtgaattttaaaatgcaaatattgctattgtttataggaaataaatctaaatataaatgaaattgaatcagtaatttatcttgggctaaatggttctaccccttactaggttgccccaattagtggcactagttggcagagctgttcatgagctgccagttatcattttggagtcagtttgaaaccagcctcttaacacactgctgttaactcataaaagagaagagtgttccatttcagtctcaataaacacttccctcattctttc

SEQ ID NO: 82256 - DNA, 3530 bp, Homo sapiens
ctgaaacctccaatgacagcttgccgaaagatgattcagttgtttctcaacttggcccattccccacgtccaagtccaattggagaacggcttttgactccgtttatatgagcatctttgatagagagcaaaggtttctggcaaggcgggatgcctgccttccacctctaatccagctgtccttgacactccagacagccctttcaaatctgggcaacacttagtcatcttactggtagccaaggaccatttgaagtgagatctaacaatatgatcgtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttccgtgagagtcatctcaaacactgcttaaggaaaagagaaacactaatggccaagtgtacatttgatttgatatacagacctccagattattttctatatttggattcacagcctttgcgctctgggttttgggatttgggtgtggggtaagttgaagggaaatcaatttaaaggaaagttctattatctgggttttagaaattctataagagacaaagtttggaagtacataaagtaataactgttagaattaggtaatggatatgaaagagaaaatgctttctcatgcatagacaagtgttttgggtttttaaaaaaaatattctgtcattggttacaaatttttactcaggctttctattggcatggatttcctttgacctctcacttttttataaattataatgcatctaaaccacctgtccccagttaatgtgccaaaatgtcaatttttaacttatctccagccaatttcaaagaaaacagaccagcatagttctgcaataacagttttaagatgggcatagggtttggaagaaagggagaaggattcttttttcaatgtactgtattgggacgctggtaactgttaacccagtgttcagcatagagctatatatatatatatatgtatatatttattattttcatataatttgccagacagagatcagaattgaaccgtcaatgtgaaataaagagttctccttgtacttgaataataaccacgattccaacccaggtctgctttggggcttatcagaactcctttctaaggagcactagaatgagaaatcatgttgttcgatcgtttcacatctgtatatcagctctaaagcagagatgtattatggtgatactccaaggtggcatagccattcatttacaacttccagatttgagctgcctggagggaatccatatcagctctgcataagattatatacaaagctgtcactcacaaaaggctggatgtgctttcatccaactggaaggctttattcttccaagttcattcatactcaaagaggccagtactttgccatccttgcacttctgttatcagggcccaaataacagtggcaagctaccaactaagttgtattttaataaagattccatgggttgaacaagccacgttgcagaaaaagagcttcccctaacctgggttgttgcagagtaaatcccacgacataagctggtatcagtggttcgggggaaatagttccattctatgactcttgtctcctcctccaggaggactgttctaactagtaatcttggccctattcattacatcctctgcttgtcattctgctaatttatgaagatagtttattatagtctgtacttcagttctcatcttgtaaataatgcttaacataaacttgtacttacactgaaatccaaaatagtcatgtttctgcagtattctgtagccaacttaaacctgtgctttcatgtttaagaaatgagaaattgtgccaaagatagcagaagagtagataagtgctcagtattgacgacctacatctgaaatctacaacataatgatactgaattgttatgtaaacatcataaatagtaaataatgattcaatgtgaattttaaaatgcaaatattgctattgtttataggaaataaatctaaatataaatgaaattgaatcagtaatttatcttgggctaaatggttctaccccttactaggttgccccaattagtggcactagttggcagagctgttcatgagctgccagttatcattttggagtcagtttgaaaccagcctcttaacacactgctgttaactcataaaagagaagagtgttccatttcagtctcaataaacacttccctcattctttc

SEQ ID NO: 82257 - DNA, 2068 bp, Homo sapiens
agcaggaggagccgggcgcgcctgccacgcaaaactaccgggctggcagggcggcgggcgcggtgcgcgatcccgggtggcggcggcaacggcggtggtgacggcggcgactgcagcggccggctctcacctctcccctgtgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcaggtggggcatggtgtcacattcattgtcatcactgatacagggattaccgccagtaaaaattgtccatgaagggacaccaagaatgtcgcagtgatgaattctttttcttgatctataaagtcccttcccaagattaaatacgactatatcctggtatgcaagatttctgcttcggggtctgggtagccaaagccatcactctgtgctcagtttactgaagccagtaggatctaggcacaggctagcacaaagactcaaggctgagtaagggccagtccctgctttcaaactatccctgctagatgggcatgcacatatccaaatgaatgctgaagaccatgatgagggatgtaagagaactctgtatggtgttcacagaggactccagagagggaagggctggttctagctgggaaggtgaacgatggcttcccagaggaggggaacatttagctgaatcttagaagaataggaatttagcaggcaaaagaaaagctaggagcatttggagtggcagaaatagcttgtgatgcagccatgggctagttacagcatacagatttcttgctatggctggcataaaggatacataaacattcctttatgtttaaacgaatgaggaggcaggggtcatg

SEQ ID NO: 82258 - DNA, 1648 bp, Homo sapiens
ccagtctgctgctcaagacatcctctcctctggaatgtagagataatacatatcatgctcctttttgttaaaacgtttttttttccccttcaaacacagtccattcatttttcagtttgggttgaaacatccttttcttgatcttgagcttataataacctagtcatattgctcagctcagatatttttactccctctccttaggcattctggttccttaaatatagttagtgtcacagaggataaataaccaaccttatttctaaggtctgagaacacttggaccacatattggttgagctcagccaccttctgattaaagttttcagacttgtaagaactgaaaatttttatggtggaagttctctgagccctcatccattctgtttttaaaaatgcattgcagatgggctatgtgaatatgtttttaaacatctgatatgtgcatgaaacaaaaaacacttgaagttattatgtatacaattctgtgggatgggacttcatgcaggattggttttcaagtttgatttcctgagggattttttagttgtttgtgaaagaaccccaggtctacttttgaaattttgtattataattgtaatgttgcccatggttaaaaaaaaaaagtgttcagtgatctatgtctcctactactcctatttctctgtttttcctctgcaggagcttgctgctgttaacagttattcttccaagttgttttctttgtggggagatgggaggtgggaggaaatataaacatatatgtatagatctttcaaaatatatgacggtatacccgtatgttctgagtcttgctgtttttacctggtaatatttagaaacatttattttgagataaaggagagcacttttaagttgaacctgtagttttaaaaagtacatttcaagtaagccaaagcagagaagtaaatgtatttttcattgttgtatcagaattttgaatttactattttaaaaattcaagagttttgtagctgatctatttcttcccctcagccatcccaaataggtcatttgtcaacagatttaagaatgtttagaaacaacaactttgggaaacgggaaacaatttggtataagtgggtgtgccataacctctctcgtagccattcattcccggatacataccctagagaaactcttacacatgcgtaccaggggatggatttaagcatttgtgtgtaataggaagaaaagaagaaaaaacccgggaagatcccaagtgtccaccaacagtgtgttggataaatactgtggtatattccaacagtggaattccacagaagtgaaactgaactgcagctatgtatgtgaacatggacaaaactcaacaatagaaggatcaaaaaaagcaagtcacagaagaatacatcactatggttccatttcaatgaaagtcaaaaacaggctgtcaaatacatgataaaaggaaacgattaagacaaaatttaatgttagccgttttgatggagggagaggtgatcatgagggcacaggggtcttcagaagaactggtgagggtctgtttctgaagcctgtgggcatttccttttttaatctgtatgtttatgtgcttttgtatgtatgatatttcttaataaaatttaaaaagaagaatgggaaaaaa

SEQ ID NO: 82259 - DNA, 737 bp, Homo sapiens
ccagtctgctgctcaagacatcctctcctctggaatgtagagataatacatatcatgctcctttttgttaaaacgtttttttttccccttcaaacacagtccattcatttttcagtttgggttgaaacatccttttcttgatcttgagcttataataacctagtcatattgctcagctcagatatttttactccctctccttaggcattctggttccttaaatatagttagtgtcacagaggataaataaccaaccttatttctaaggtctgagaacacttggaccacatattggttgagctcagccaccttctgattaaagttttcagacttgtaagaactgaaaatttttatggtggaagttctctgagccctcatccattctgtttttaaaaatgcattgcagatgggctatgtgaatatgtttttaaacatctgatatgtgcatgaaacaaaaaacacttgaagttattatgtatacaattctgtgggatgggacttcatgcaggattggttttcaagtttgatttcctgagggattttttagttgtttgtgaaagaaccccaggtctacttttgaaattttgtattataattgtaatgttgcccatggttaaaaaaaaagcatcctgactcttttcaactcaaatcccagcttaaaagatactcaaaacatttgtgtctattcctagggagcacaattctaaaattattgcacagatttttttaatttatta

SEQ ID NO: 82260 - DNA, 601 bp, Homo sapiens
  misc_feature (457)..(457): n is a, c, g, or t
  misc_feature (477)..(477): n is a, c, g, or t
tatttttaatagtgacggggtttcaccatggtagccaggatggttttgatctcttgacctcgtgatccacctgcctcggcctcccaaagtgctgggattacaggtgtgagccaccgcgcctggcctactatagctgtttaatatgtgaaatctaaatggcatttttgacttgacagctcagacttgtacttcatgtattcagaagtttttagacaacaattagtttattgtctagttcattattaaagataatgaactaggccgggcgtggtggctcacacctgtaatcccagcactttgggaggctgaggcgggcagatcacttgaggccaggagttccagaccagcctggccaacatggcaaaacctcacctctactaaaaattaaaaaattagccaggcatggaggcatgtgcctgtaatcccagctacttgggaggctgaggcagaagaatgnttgaaccaggaggcagagantgcagtgaggtgatcattggtcactgaggctccacctccggttcaagtgatctcgttcctaagctctgagtcaggtggagtgcgggctgccaggcgggtatgagaattaagggcgggccccagg

SEQ ID NO: 82261 - DNA, 739 bp, Homo sapiens
  misc_feature (595)..(595): n is a, c, g, or t
  misc_feature (615)..(615): n is a, c, g, or t
cagggtaaaagaaagagacttttttctgaagaatggcttgaacccaggaggcagagattgcagtgagccgagatgggccactgactccagcctgggcaatagagtgtgactctcaaaagaagaaagataatgaactggtttgcatttcttttaaaagagatgatagaggaaagtatagtttcgtaggaatgtgtatctctcttaaaagataatcttttaattttgcttcagataacaagttattattattttttaagaaagcctactatagctgtttaatatgtgaaatctaaatggcatttttgacttgacagctcagacttgtacttcatgtattcagaagtttttagacaacaattagtttattgtctagttcattattaaagataatgaactaggccgggcgtggtggctcacacctgtaatcccagcactttgggaggctgaggcgggcagatcacttgaggccaggagttccagaccagcctggccaacatggcaaaacctcacctctactaaaaattaaaaaattagccaggcatggaggcatgtgcctgtaatcccagctacttgggaggctgaggcagaagaatgnttgaaccaggaggcagagantgcagtgaggtgatcattggtcactgaggctccacctccggttcaagtgatctcgttcctaagctctgagtcaggtggagtgcgggctgccaggcgggtatgagaattaagggcgggccccagg

SEQ ID NO: 82262 - DNA, 2408 bp, Homo sapiens
  misc_feature (9)..(9): n is a, c, g, or t
  misc_feature (306)..(307): n is a, c, g, or t
  misc_feature (448)..(448): n is a, c, g, or t
  misc_feature (1274)..(1274): n is a, c, g, or t
  misc_feature (1774)..(1774): n is a, c, g, or t
  misc_feature (1861)..(1861): n is a, c, g, or t
  misc_feature (1895)..(1895): n is a, c, g, or t
  misc_feature (1900)..(1900): n is a, c, g, or t
  misc_feature (1917)..(1917): n is a, c, g, or t
  misc_feature (1920)..(1920): n is a, c, g, or t
  misc_feature (2030)..(2030): n is a, c, g, or t
  misc_feature (2403)..(2403): n is a, c, g, or t
gtgatagcncttaatgttcatttatttatttactcactgaatgaatgaatgattgacattgggacatcatgaaagtttactgacagaaataagtaaacttcatgaaaagtagaacatcgtggaagtttactgacaggaataagtaaataagtaagtttactgacagaaataggtatgaataatgccttcatattaatatataatatgctcatatctgtggaaagttcagtccacgtacaccaagtatggccttctcaactcacaattcacaccaataaaaaaatttaggtacatatgatgctttcnntcatgttcattcattcaacagctgttctatttggactgatcagacgttgttctcacatcaaatccaagaactgaaaacattatttaaagtttctctcgagtttttaagaacctacaactatttatggagaaaaagcagccnaaggatgatctttttgatagactcaatactggtattctgaataagcatctccaggatctcatggagagcttgacagccaaggtattccatacatacaatgcctccatcacgctacagcagcagctagaagaactcacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagaaacctgaaaagtgctaaggctgatgccaaggtcatgaaagatgcaaagatgaagaaggtagtagagtcaaagaagaaggctgttcagagactggaggaacagttgatgaagctggaagttcaagccacagaccgagaggaaaataaacagatggccttgggaacctccaaactcaattatctggatgctaggatcactgtgccttggtgcaagaagtggggtgtcccaattgagaagatttacaacaaaacccagcgagaaaagtttgcctgggccattgaaatcgctgatgaagactacgagttttagccagtctcaagaggcagggttctgtgaaaaggaacagtgtggtttgggaaagatggataaactgagcctcgcttgccctcgtgcctgggtgagagaggcagcaagtcttaacaaaccaacatctttgcaaaaagctaaacctggagatattataagggacagctgagccagttgtcctacggacaacttatttaaaaatatttcagcnatcaaaattctagctgtatgatttgttttgaattttgtttttattttccagagggcaagtggatgggaatttgtcagcgttctaccaggcaaattcactgtttcactgaaatgtttggattctcttagctactgtatgcaaagtccgattatgttggtgtgtttttacagttagggttttgcaataacttctatattttaatagaaataaattcctaaactcctccctctccccatttcaggaatttaaaattaagtagaacaaaaaacccagtgcgcctgttagagtcgtcactgtctattgtcatagggatcaattttcattaaacttgaagcagtcgtcgctttggcagtgttttggttcagacacctgttcacagaaaagcatgatgggaaaatatttcctgacttgagtgttcctttttagatgtgaattttattcttttaatatttaaaatattaacctttctgatcttaaagatcatgtagattggggtgggnagggatgaagggcgagtgagtctaaggataatgaaataatcagtgactgaaaccattttcccatcatcctttgttctgagcattcgntgtacactttaagatatcctctttttctttttanccctnatctttcacttgaaagnttntattgtataaaaagttccacaggtcaataaatttagaggaaaatgagtatttggtccaaaaaaattaaaaataattaagattttagggcttttattttttcttttgtaantgtgtaaaaaatggaaaaaaacataaaaagcagaactttaatgtgaagacttttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaacggaaaaaaaaaagtttctcttccatctctagtaaaattaattgcctccttttaccatctctagtaaaattaattagcttcacagataccctctgtagataaactcctttaatttcttcctaacatacaaaacattcccaaatatggtttgatttccccaaaaaatgtancaaaa

SEQ ID NO: 82263 - DNA, 619 bp, Homo sapiens
ctggctgacctgaggacccaacaccgcaatctcatgttccagatgaaacccaccatattgcagctgacaacttttcatccagaatgaatgctgcttacctaaagctattatagttttactgaggttgttataggtagataggtaataatgaaggtactgtttgatagcaattaattgtatgatggcttttccatttgtagtcaagattggaaacaacatgaaatatattctaaaacatttcactatatagttacatcctgtttctaagtatgaagaatgtgggatgtaagaagtttgcatattactttgaagaaataaaaatcatgaaaacaaagaaatcattataaaatgaattattactaccagagttttttctccccagcgaaaggttgtcatgagcagagttttaagtagagaatggaatctgattttgtgaaacagattccatttagaattatattattgaaatttgaattcgcatagagtgaaccagtaagagaaaaatggcattattaagaaaataaatcaaacacagatttattaggatatgaaaatttttaggaataatagaaaagaaagagctatgttttaaggaaaaggcctagattgtccatattac

SEQ ID NO: 82264 - DNA, 239 bp, Homo sapiens
ttcttcacttgtagtatgaggaagcagaagtgaacagcactgctgctcagctgcagttgcttccataggcttgctagaagcaccagaagtctcccactgggcaccagaatctttgggttgtgtgccatcaggtcttattccatatatggaatattattgctcctcaaaagaaaaacatgttgagacagtagttattaagaagtcaggctttgccacaatcccttttaaatacagtacct

SEQ ID NO: 82265 - DNA, 732 bp, Homo sapiens
tttttgtatttttagtagagacggggtttcaccatgttggccagtctggtctcaaactcctgacctcatgatttgcccacctcagcccccccaaagtgctgggattacaggtgtgagcctccgtacccagccccctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagactcagtaaataatcactctaagattggaaacttgaaatcctaacactggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatggcatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgt

SEQ ID NO: 82266 - DNA, 1256 bp, Homo sapiens
tttttgtatttttagtagagacggggtttcaccatgttggccagtctggtctcaaactcctgacctcatgatttgcccacctcagcccccccaaagtgctgggattacaggtgtgagcctccgtacccagccccctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagactcagtaaataatcactctaagattggaaacttgaaatcctaacactggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatggcatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgataacttcctgctatgagtcagctaaacattcctgaatccaaccattctaccgccggcaaactccagtatctgatgctctatcacatgtggaaacaaagtcactcacatgggtttcaacaagtacactgcttagtgaaatatggatctttaaaaacatactggaatttgaaaaaataaaccacacactgatggtaatgtcttcctctgaatgaatgtgtgtaaaactgtaacaggcacaaaaaccaaagccaaagaatcaaagacttacatctgtcaaacctattccacagaagccatttcaatatcagggctatttcttagataggtttaaaaatgtatctcacaatttaaatttgaaaacaaagcaaagcgcaaacaccaagtagaagttacactacacggaccatgcaggtcagccaggtgtagaagataaatggtcaaaatatgctaagaagaagaaaactaagaaaggtacatagagcaattcaatctctaccaggttttctgaataaacattggaatttaatcgaattaaaaataatttctcat

SEQ ID NO: 82267 - DNA, 1178 bp, Homo sapiens
  misc_feature (7)..(7): n is a, c, g, or t
  misc_feature (55)..(55): n is a, c, g, or t
  misc_feature (65)..(65): n is a, c, g, or t
  misc_feature (71)..(71): n is a, c, g, or t
  misc_feature (77)..(77): n is a, c, g, or t
  misc_feature (96)..(96): n is a, c, g, or t
tggactnaaaaacaccgggctcccttaaaatttaaaaacagctcaaagacaaccnagaatcttgnctgtgntttaangttaggttaaaaacgctgnaactttaaagaagctgtagactgcaagtttgttgttatgaagacctgctagctttgaagcctttcaatttctgtacaaagaatgattcgagaacttctgcacactggtaaaatggggagtcacttggattgtagtaacgacagttatcaaaaattttggtcatatctgccacaaattccgtcagcttttcataatatcgtctttgtactctttcttccatggtggcaaggtacataggttccttaataacaccataataatctggtgcatcattagggtctactggttcaaggaaaggccaggccatcttatgggcctgtaaggaacggagcaccctcttcaactcctcatcatccttctctgttagtggtgtgagcactgtcatggcatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgataacttcctgctatgagtcagctaaacattcctgaatccaaccattctaccgccggcaaactccagtatctgatgctctatcacatgtggaaacaaagtcactcacatgggtttcaacaagtacactgcttagtgaaatatggatctttaaaaacatactggaatttgaaaaaataaaccacacactgatggtaatgtcttcctctgaatgaatgtgtgtaaaactgtaacaggcacaaaaaccaaagccaaagaatcaaagacttacatctgtcaaacctattccacagaagccatttcaatatcagggctatttcttagataggtttaaaaatgtatctcacaatttaaatttgaaaacaaagcaaagcgcaaacaccaagtagaagttacactacacggaccatgcaggtcagccaggtgtagaagataaatggtcaaaatatgctaagaagaagaaaactaagaaaggtacatagagcaattcaatctctaccaggttttctgaataaacattggaatttaatcgaattaaaaataatttctcat

SEQ ID NO: 82268 - DNA, 900 bp, Homo sapiens
tttttgtatttttagtagagacggggtttcaccatgttggccagtctggtctcaaactcctgacctcatgatttgcccacctcagcccccccaaagtgctgggattacaggtgtgagcctccgtacccagccccctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagactcagtaaataatcactctaagattggaaacttgaaatcctaacactggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatggcatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgataacttcctgctatgagtcagctaaacattcctgaatccaaccattctaccgccggcaaactccagtatctgatgctctatcacatgtggaaacaaagtcactcacatgggtttcaacaagtacactgcttagtgaaatatggatctttaaaaacatactggaatttgaaaaaataaaccacacactgatggt

SEQ ID NO: 82269 - DNA, 2228 bp, Homo sapiens
gagctcgcggcagtacggggagcgcccgcccgccccgccctggacccaaccaagcgtcccgcggaggggtgcggccacttgggggcaggagaaagcggagtacgccacccctctagggacccaggaagcgaggcgagcctcaggtggacgcggtggtgtggaccacggcgatcagggcctttccccctgctgtggagacggaggtgcgaggggacgccggcggctccccaccttctggccgagtggccttctccgcctccggctggactccctcggggcgctccctccagagccgagtcgggctggccgggggcggctgtttggcctgagtgtcgtcttactaaagcggaacgccggaggggaggccactccgagagaaggcggtccccggcggaggtggcttcgtgaatcctgcagccccctgcccgcccgccactcgagacgccgcgcctcgtgggtttcacgctggatggagggggcgccgccgaggatgcccagcctccccctctaattctacctctccagttcctcaggtagacacagcctctgtctgctgtggttttagtgcccatggcccctcagaaattatttttgtcccctcccgatagtggctttgggggatggagggcgagagatgcaaagggccagtggaagattttttatagcacaaggaatcaagccaggagatggaggtttcattgccacctcggggtctggggagggggcgagccacacctctccggtcagtctgcgcccaccaggacctgctgctgggaaccgcacacgaaaggagagacacccagcacctggcccctagacccgcagggcgtcaacctcctgggcttctgcctttctaggtttcctctgactttgctgacccaatgacccctggccacgggtggcaaaaacgccctcactgagcccttcgctaaaggagtgccggggtttatgtgtctggcttttaaaatgggatgaggagacaaggaaacaggacctgagaaaggacactatccaaaatctgatgctctcagaagtcaactttaaaactgccctgctccgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaactgccctgctcttttcatccaaagatgaatatatgaagccagctgttactggttgaaagtgtgcctcttgtttgcatggcaaaggaattcagttttgtgtttatttacagctgaagctctcttgaaataattgtctcagtcacagcttttacattttggggaaccatgccattagaactgaatattaggaactgtgatcttttgtcttttcacaattgacaatacattcagaacttatttctgataaaactgggcagtttctaaggatactgtacttatgatttaaagtcataactccatgatgcaaaagagaacaagaaatatgtttcaatgactgccttttaaattagcggtactccagcactttgggaggccgaggtgacaggatcgtttgaggccgggagttcaagacagcctgggcatcatagccagaccttgtttctactaaaaataaaaaataaataaattttccgggcatggtggcccatgcctgtagccccagctactcaggaggctgaggtgggaggatggcttgggcctaggaggttgaggccacagtgaattatgattacaccacgggactctagcctgggtgacagagtgagaccctgtctgaaaaagaaaaaaaaaaaatgtagctgtacttaatgtactaaagttaaaaattggataacaatagttgaggacagtgtaggcatttaaaggtagaggattgccactttttttctcatttttgtcttttatatgcatcagaatgagtgcatattgtatactacttggtaaggtcttaaattaatttggtacctactgagataatccggcatttcatgtgtaaagataaattagataaatgaataatatatcactatcttgga

SEQ ID NO: 82270 - DNA, 277 bp, Homo sapiens
  misc_feature (84)..(84): n is a, c, g, or t
  misc_feature (86)..(86): n is a, c, g, or t
  misc_feature (91)..(91): n is a, c, g, or t
aaatctgccctcattactggtgggcactatctagtaggccagagaggacaaatactgaaggtgaattggtctgtgtctcagagnanagggnacagccttttctcctgctgccttagacattaaaattccaggtttgacatcctttgggctccaggatttacaccagcagcccgccgggtcctgaggcttttgatctcaaactgagagttgcatcattggcatccttagttctgaggccttcagactgggactgagccacactgtagatatcccagcg

SEQ ID NO: 82271 - DNA, 648 bp, Homo sapiens
ctgggtaagaggagacgggtgccccccacccactcctcccggccgcgcggacctctcccgctcagacctgcatctgcattcctttgagtttaccacggacttggggcgggatcaaagggaaagtggcctgagcctgtttcatcaaggggttgtggaccgaaaccaaggccgggggtggcggagggcacgcggatgaggggctcaggcctaggaagggccggtcctggacaccgcgccctcccctgcagccaggcgccgaggcctgcagcacccggagcgccgcactgacccgcgattctgcccgaaggccggcccgggtgcgccccggcgcggggagacaccaacaaggccagcttttccacgagaggctgcttagctcttgtgaccatatttggtctggcgaggaggcatcttggctgcctggctctcaattgtctgctagagcacagacggtgcccagaaagtgcctctgtcactggagatgcggcttcgccaacgggcttgagtgcaatagctccatctcagctcactgcaacctccgcctcccgggttcaaacgattctcctgcctctgcctcccaagtagctaggattaagacgcctgccaccacgcccagctaatttttgtattttttaaaagcaaaaatgg

SEQ ID NO: 82272 - DNA, 239 bp, Homo sapiens
gtcattctagaggatcccggcccccctgtggattggaggaggttgcacacagtggggggatttgaggaggctgcacacagtgtgggggatttggggaggttgcacagagtgggtgggatttggggaggttgcacaaggtaggggggatttggggaggttgcacacagtggtggatgtggtgaggttgcacacagtgggggggatttggggaggtttcacagactggggtagatttgggg

SEQ ID NO: 82273 - DNA, 529 bp, Homo sapiens
tctgggtagaaaccagaacatgctctccacagcctgggggagtattctatacctttgcagaggatgacctgatttcccacccataaagagaaatacgattttcctactctccaccagtttcacggataatgctatcaggcagcctgattccagggaggacccttaatttagaaaggaaaaagctaagacctaacactttgtctctcactaagggagtctggaattctgattcctgtttcaggtctataatgtgctctatgtaggaggcaaaaagaagaggatctgaatcctttggtgagtctgggactccaggagattgcaaataagctctgcaggagcactcttcccaggaggagggggtctatggccccctggggacctcatatgctgagcccacagctctgatgcctctgcaatttctcagaggtccactctggaggccatcgtccctgctgagccccccagagacacagggagcttcgatctcagcaatgggacattgatttttacaactccagcaacaagagaa

SEQ ID NO: 82274 - DNA, 268 bp, Homo sapiens
gctcagtaattgtcagctgtgagtattagtagtagctaatacactactactattcttggctaacaagccagctcaaagctttgatggttttccattacctgatgatggtgatgatggtttccacttcctgaacactcacacccctgggctaggcacttaacccaaatccaaggtcagcgttattgtttgggggtgggggagacacctcctgctctgactcgtgtgtttgggttcccgtattttcaccagagggtgttagtcctgccca

SEQ ID NO: 82275 - DNA, 350 bp, Homo sapiens
tttcttttcttttctctctctttctttctttgtttctttttcttttgctgttgtgtcatccccataaaatagtcatccttaagagtttttctattttctgctcaggaggggttggcacttcaaaataacagctgacaaaaaggtacaaactatttcttggttttgttttggcaactgtatggctgaaagtgggagagcagcacagagctgtgtgtggatgtcagcagctgccagagacttcgcagagggttttgtcacagtcgccacaaaacactatgtgtttaaactggaagccagtcacaatgagagaccctagtaacctttatgctagagaaaagcaaattgccatt

SEQ ID NO: 82276 - DNA, 633 bp, Homo sapiens
aaaataaaaaacttaataaagacaacacaggaaattatcttgataaaacataaaatctttgtttcgtaggccagttaccaaaaaggtaaagaaaaacctcctgtggtgtgattgcttctcctcatgggaagcccgtttggtttgcctggaagtagaagctgatgaaaagtacttgaatttaatgagacataggaagagggtgtccagtattacgagtgcgcaccgtattatagaggaatgtcaatgtgacagttagtggcttgagcagggcagtacagggctctaagtcacagtatgggaagttttctggttccatggaacaattcagacacatccagaaaagccgaatgtacagaatcgagttatacaggcggaaaacagtgcatcagaccatagtaacacagttaaaactggagaaaaaagttccaggagctgacaaaaaagttgaaggaaagagtccttgccctagccaagcaagcagctgcagcttctcaaggggagagagtggaaggcagtgatatgcggccagcaggtcacacgcagcaaggccaagcccaagccgaggctgtcagattcacctggagaggaagaccctgcctggagaaatgaaattgccattctaaatgaagacag

SEQ ID NO: 82277 - DNA, 157 bp, Homo sapiens
tccaacgtggataccctgggaggtcactctccccaggctctgtccaagtggcataggggagcttagggctctgcccatgatgtacagtccctttccacaacgttgaagatgaagctgggcctcgtgtctgcgcctgcatattcctacagcttcccag

SEQ ID NO: 82278 - DNA, 914 bp, Homo sapiens
gtttgcctgtctggctgcctgggtctttggtttgctgagggctgcatggaggctatgccctcctctccagcccctgcgttgggaagtcacaggagaccggagctgcgcacgacatcacagcgccgaattctgacccaatctgaatcaaatgtcacccataccctgtcttcaacaaacaaaagagcaacgaagccagagacatcatcttcagctgccttggcctgtgtgccgggggtcccgtcagctgcaggacacgggagggatggagtgaagcagaaaggccccgccgtgaccacactcatcccagaagagcctctctgttggcatgaaaggaaatcacaaggaaagggacttttcaaggtcagactgcaccagtggaaagtcagcaccagcccccagggctcgaggcagcctgtgccctttccactaactgtgccaactctcaccaggggaaggctgaccaggaacaaaggcccttagaggagagcagaactcctgcagcctgcacttccgagagatcctgctccacggagcccggctctactcctgcaggcagaacctgccagcccgcagatgctgggggctgaaggatcccggcgacaccaagcgtcaggtcaggcgtcagaatccagcgcgtttgctcctcgagaacagcgcgccacctgctcccaagtgtgtgaggggctgcagtgccgagctccacttcacaagactcactcctgccccgccacctcctgagcagacgcagtcaagcccgacctacctttcaacaaacatgtattagcactccctccatgccaggcactgtgccaggtgcgagggtaccatgaccaagccaaggccccaggctcagagcactcacacgccagtggagggggcagccctgtgcgacccagcagggcacaccccacctc

SEQ ID NO: 82279 - DNA, 906 bp, Homo sapiens
gaacatggatctggtttttactctggggatgtagcctattaaagaaaaccgaagactgagggggtcttgggcattgacgtggttgacatgggcatttcttaaagcagagcccccccaaaccccactcatttcctttcctaagaatttccaaacccaaactcaagtggagccgggcgatgcttggggttgagtcagtgctcagctgtagagggttgggggagggcccttccctctctccccctctgcaggcagcaaccctgtacccagtcacagggtacagttttccagtacaggaggaggaggattctctggtcaatggtgtatctgctgctgcattccacctgagtgagtcttcagggcctatttgtagcctgaaagcagaacatgctttgaatttccatcttcagtgctcctgagcctgcaccagtgaagtcttcctggggacttggtgatggacttgaaagagccaggctctagagtctctgcagagggtgacccaggatgagtctctcaccatttctgagcctcagtttcctcattcaccttcgttgtcatgtggctgcagggagtattgttatgagataatggacataagaagctttctgaaaagaagcaagaccctcattctttaataaaaatttgatcaactttcccagtagaacagggctttaatttcaatcaccattatccatttccttttgcagtggtgctcaatcttggtggtgcattagaatcccctaggagcactgacaacgggcagattcctgggtcccacgataggcaatgagagcagaatttctaaaagtgaggcctgggccatccagagtttcagaacctcccaaggtgattctacctaccttgccaggactgagagccatggggatctggggaaagaaacagtagtta

SEQ ID NO: 82280 - DNA, 371 bp, Homo sapiens
gtcaatacaagccaaatacagatgagaatctgggccaggcttacctggggattctgtccaatggttgaaaagacggtacagtgtcagtgacgtttttggtgatggaagtcctcagtgtgtcttttgatgtcaaagatgtcttgtctttggactgacaggagcatgtgatctgtggtccaactgtttgttatcctggtatttccctttactgtcatcttggggatattatttacttctctctcctccatttgatctcccaatgcatattatgtcatgtctttctctctctctgtttattctttcattttgctggagtatatcttatagtaacaacttggggaaggatgtctggcaggtaaattttgagattt

SEQ ID NO: 82281 - DNA, 676 bp, Homo sapiens
tccaagtcaaactcctgagctgggttaagaaattggaattcctgaggctctggttcaggttcttactacctctgtgacattgggaaagttggttaccatcatagcgcctcagttttcttatctgtaaaatggggaaaatacatgagttaatatatgtcaagtgcttagtgaactgtctgggtcatgttcagtgctataaaaatgttcattgttgttgttgctgttgtttctatcgttgttattattaaatgggtcccaaatcttgaggcaagtcatttggaaaaccagcttgttcgtgctttgccacatatagtcatgtgccacataacaatgttttggtcaacaactgaccacatacaggactatatagcctaggtgtgtagtagactataccatctaggttgtgtaagtatactggacgatgtttccacagcaacaaacccacctaatgatatatttctcagaacgtgtcgttaagcgacatgtgaccgtattatacgtccagcaattgagatgaattaccgttgcacacagtgctgaagctcaggtgtggacaccctcttttaaaatatttttcccatgaacatgtcctccaggaagcaggctccagtgtgtcacagccagatgagtgattgttagggaagacaaagcctgtgtttagagttatgcaagtata

SEQ ID NO: 82282 - DNA, 405 bp, Homo sapiens
tttaaatattaagttaagtatataacttgccctatgccatattgctttaatcaggggactgagcatcacatttagatttgatgagtttgggaaaagttctcaaacatccagacccatggaccttaagaattactgcagaaatctccttcaatatagttatagggagcattaatgcttttgtggtactaaacatatttttgagcttagatacaaatccttcttgtcctgaactgatagggtaggaattgtttaggtgcttcaaatccagatctttcaggggttgccacctaaactcatctttatgagtaactctagataataatacactttggtatcttccaaagtgcttatctaggcatggaaaagttcagtaattatcatgaggactgtttgtagtttagttct

SEQ ID NO: 82283 - DNA, 332 bp, Homo sapiens
gcaatttaaaagcatttgaaaggaaatcatttttaatagaggaattgcaaaccagagaataataagctcctggaaggataagggtaaagagttttgtgtttgttattacttctcctatagcaagaaattcttattcaaattgaaacggtctaacagttgtttgtttgggtgttttgtttggttagttggttttgttttgtttttttctaattaaaaagtccttgttacatcaagggactcataaccattccctattggcccctggatactttgcatatcctgaaacaaccagcactgatcagaaagcattcagtccagtcagaattcaaggt

SEQ ID NO: 82284 - DNA, 310 bp, Homo sapiens
gccccgggcttgctgtcatttttctcttttatattgatttcatgttcaccaactcctataaatttctgcaaacaccttgcctctctatagaaacaccttgccattatgtcttccttttcttgccctcaacagaaaagtaaagtgcaacatacaatctcattcagggcctctagaaacatctgtgcctccaaaagttaaacacagcttataaatattatctgatatacagatcaattgcaggatagagagcagggttgtgcattaataaaagcatggagtttagagtcaaaagtccttcagaaaattctgc

SEQ ID NO: 82285 - DNA, 1002 bp, Homo sapiens
  misc_feature (20)..(20): n is a, c, g, or t
gccaagaattcggcacgagncggcacgaggcggcacgaggcggcacgagggttgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaaaaaaaaaaaaaaaaaaaggacaagaactgtcactaacctcatggaggggtttgcgtaaaaccatttagcccaccttgagcaaagggtagattccgtgttgtttttttaagctcactgtaataaaataaatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatcatga

SEQ ID NO: 82286 - DNA, 1017 bp, Homo sapiens
tctgtaacaataatggcgtaagcctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaaaaaaaaaaaaaaaaaaaggacaagaactgtcactaacctcatggaggggtttgcgtaaaaccatttagcccaccttgagcaaagggtagattccgtgttgtttttttaagctcactgtaataaaataaatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatcatga

SEQ ID NO: 82287 - DNA, 726 bp, Homo sapiens
gtaagatgcatgatgaaaatttaagtagagaggatctttatggttaacttataatatcgagtgatgcatgaggtagatgttcagattaatattctgcattattatgaaagaaaaacattcttaattttagttaaagtttagtatgatttattgtatttttatgaaatatatgtagcatatttttaaattataaattgcatgtgaacttttcaaccaaacagttttaacatgttaaatactatcatgaattcaatgaagtgttattatgccagtaactttaacctattccaccttactcaagggtgtaggtaaaagatggtaaaaatacactatttggtaagataatggactgacatctctagtgattttttttgccagtgagttttaattgccattaagttaaagaatattgttcccataggctaaatttttatttttattttctcatttaaatgtatttgacttaatttttgtggatacctaatatgtgtacatattatgccatatgtggcatattttgatacggacacacaatatataacaatcgcattagactaaatgcggtctccattacctctagcatttattctttgtattacaaataattcaattctacagttttagttatttttaaatgtacaattaaattgttgttgactacaggattatttttatggtcataataaaacttatatacaaacataagtaaaatccatatatttctga

SEQ ID NO: 82288 - DNA, 372 bp, Homo sapiens
gtggtcctgctctggagtccacattcgtaaatattatgctgcagtaaatattaatcttgagaactaggtgatatggtttggctgtgtcccactcaaatctcatcttgaattgtagttcccataatccccacatatcatgggagtaacctgatgggaggaaactgaatcatagggcagttatttctatgctgtcctcataatagtgagttttcactatatctgctggttttataaggggctttcccccctccctttgctctgcatttctctttccggccattatgagaggaaggacatgtttgcttccccttctgccatgattgtaagtttcctgaggcctcttgagccatgctgaactgtgaattaattaaa

SEQ ID NO: 82289 - DNA, 686 bp, Homo sapiens
cggagtctcaggccctgcccactcccagacacacactgtctgcagcccagggcccgtgggtgccccctgccaggctgagggacagtgacacaggtgagggaggtaatgggggagccctgctgccctgggagaggggacgaggaccccacaggggccaggcctggccaccactcgccccaggctgggaaaccaggacatgaccctcccccaccctgctcgcaggttgtcgcaggacacgtgttcgtgtccaggtgcgctgggaagggtcctggcggtgctcctctcagcgcaggtcccgaggagctacaggcatgacgctgccttcagaactcccccgagcctgctccttcccagccttggctcgtgaggctcctccgaggaccacgggccttccacggcgtagccctgccacgaagcctccccatgtcttgcctccagcatcacctggccgagacggacctagggcgtccttctccagcatcatctggccgagacggacctagggcgtccttctccagcatcacctggccgagacgggcctagggcgtccttctccagcatcacctggccgagacgggcctagggcgtccttctccagcatcacctggccgagacgggcctagggcgtccttctccagcatcacctggccgagacgggcctagggcgtccttctccagcatcacct

SEQ ID NO: 82290 - DNA, 574 bp, Homo sapiens
agcacacactgacaagacaaaaagctcaggaaaaggcagaaaaattactcctttataatcaagtattatatataagtcagtgctcataattttgctcaagaaaatattgacttacattcaaaatatatctgttctggcatagagagattatgttgttaaaatcatgttattgaaaaaagttatttcagtggggaaagaggttagttaacaaagagattcacagtaacaaatcctcctttctggagggactcttcctgaccctgagctgcacaactttgcaacaaattaaagcctaaccgaagatgacctcacaatggcaatttagaactcatgggagtcaacttacataaacggtatttgatttctgataagatagtggaattattggttatagatgacaaaataagtatgtttaaagtgatgatggacataaaaaagttttaaatataaaacatgagaaaagaaggagatactattcaaaaagactggcaaatttgaaaaactagaaataaaaaaaaaactcggtgggggctgtgtgcagtggctcatgcctgtaatcccagcattttgggag

SEQ ID NO: 82291 - DNA, 768 bp, Homo sapiens
aaaagatcttctaccttctacccttgctgccttggaaacctgggaccaccatgctgtgaagactccagggacatgaggccatggaagaaagtcccaacaaacacaaccaccccagccatttagcctgatcccccacactgagtctgttattggtgttcttgtaatctcccaggatagaaatcaagagagatcaccagccacagcagcaaagaaaaagagaaagcttcatttagctggtgcacagggaaaggcagcaccatggaagtagttaacagttctgcagaacattttagaaatggtaacataagtataaacaacaaaacagtgagattctgataccaacttccagttcctcctcaccaagacttcgtgaaaactcttcagctcatctggcaaaacaaacaggcaaagacgcagataccaggacacttccttttgaacacttggctgcagaagctaagagacatgggatacgcgaattgattcttacataatatgagagatatagggctggaccacacgtgattcccgtggcacgctgcttctgagcactctacagccgccctctagccaaacccagcaccggtcagatggggagaaaccagagataggaaagtgctcgcacgtgggaggtcacagtggagcctccgtgagaaccttcaccagaagaaggttacaggccatgaactgcagactcaggaagataaattggcaaagcagcaccgcgatggaagagctcctggcagcaatgtaaatactggagcccag

SEQ ID NO: 82292 - DNA, 1019 bp, Homo sapiens
cactgtgacggatgagtggatatttctttgtaccctgagctctttcatcctaccttggtggtcaaatgtgagagcaagtgctttggggctcagagggcatcactccaagcattctgcatggagtctgttgtggtgaatgttcttgctggcatcttgatcaaggactttgtcatcattagccatcaaatgcttgttggtccttctcaaccctgtaatgttgatacttaaaaaactggaaacatcctgacagaaacagtcgagaagtggttgtgtgagctctggttatcgcattacagttaaagttggcagataggttctgtattcagtgccccatcaaaaacagaacacagactatataaggggaatattgtttgtaagtaactctgtgggctaattgtgcaaataggtgctagaatgctgggcagcctttttccttcttcgtggctttgttgcattttattgtattgttgtattgcattttattgtaatgacagttactccttttgataagatgatctcagtagataggctgaattgtcctgtttaaggctacttttctcctctgaatctaaaggtgttcgctgtcagagctagtacggagttttgaatttggcactgtgttgcctaaccgtcttctccccccgccccatccccgcataggcaaatagttttactagtttgacatttaatcaaaatttaaacatggggccaaggaaggtcctccaggaagcattagtatgaaaaatattgtaaacagtagctttgttctagccacacaatttggatttctcaagattaactgtctgtacataaacactcttgaatagctatgtattaactttcccctactttgagctggaaatagcttctcttctccagttgatgtgaatgcaggggtagtgtaccctacatggactgtgtattactcctttaagattgttggtcttgctgctttgttctctcagtgtaaagcacaagtcacagaaccatggtttaccttaactagagccctcctttca

SEQ ID NO: 82293 - DNA, 325 bp, Homo sapiens
gttgacctgatttgagactaaattttattttaccttcctatctatctgaatccaaagcctcctctgtcagtcatcaacagagcccttgctatcgcctaccccgaacctctttcttcttagacaaatagcaatcccagcaataaggatgtactctgtaactcttggataattttccaaagatggaatggactaactagggaagcaaggagttcctcatcactgaagaggagttaaggaagctgggtgatcatttgtgaactatgtacgaattaagtaagtaaataaaaatcatagctatcatttatttagtgctaggcacaatgtt

SEQ ID NO: 82294 - DNA, 439 bp, Homo sapiens
acacatacaaaaaaggcctcatctgaacagtcattatcatcataaagatgacaggggtttgctggccacatctaaacaaaatgcaaatactgaaaaccaggcagccttccaattaaaaaaaaacaaaagactttcatcaagcaagaactgtataatgaagagtctgctgagactaaaatagttttgtgattttatcagatcaacatgagtgaaaaaagggggccagcctgggcaacatggcaagaccacgtctctactaaaaatcaaaaaaattaaccgtgtgtggatagtggtgtgcctagagtctcagctacttggaagcttgaggcaggaggatcgcttagagaggctgcagtgagctatgatctgccactgctctccaacctgggtgacagtgtaagaccctgtctcaaaaaattaaataaataaaaatgagtga

SEQ ID NO: 82295 - DNA, 314 bp, Homo sapiens
ttgtcttttatagtgccagcaaatttgtaccttctggaggcttttcaagattgtttcagagtgagactccatctcaaaaaaaaaaattttcttgccccacccatactcagcctttgactcttttagtgtttaatagtttgattaattgttaagttgtggtcataaatattaagattatggagtttaatataagtcctaaaaagcttagtatttgaatataatagaaatggtagatgcacctaatggggaactttcaaacctgcacatttgtattctttttccaaagcagggatctgtcctttccttacagaatg

SEQ ID NO: 82296 - DNA, 323 bp, Homo sapiens
  misc_feature (21)..(21): n is a, c, g, or t
gtcctaacccccaccgtgtangtcatactgcacacacatgtggctatacacatgtgcttcctttgccttgctactaaaacttcgacttgtgcctgtactccctgtaccccaagatcactccactgcctccagcctgggtgacagaatgagatcctgtctcaaaaaaaaagatataaccatggcagttagccaggtgtggtggtgcatgcctgtaatcccagctatatgggaggttgaggcaagagaatcgcttgaacccaggaggtggaggttgcagtgagccgagatcgtgccactgggcaacaaagcgagactccatctaa

SEQ ID NO: 82297 - DNA, 465 bp, Homo sapiens
gttaaaaactatttcaaattatacactgtatgtgttcttatcctgaatttatttttttcttcaaggttttgtctctgatttttacttttttcttgcttccagaaagagaccaagaatgataagtgttaaaggggaaaagtttaaaggggggaaaagttactgtagttttctaccacattttaagacctatgggaataaagtttattgctatgctaatagtttactaggaaacttagaaagaattatgtatagttcagtttgcaaataaaatatattgaaagaaacatctgaaatattcttccctaaactgcaaaaaatgacgaataaacaagtctctaaaaaagggaaaagacctcatagttaccctccttattactaatttgaagttttaatggcatttatttgacacataatattaaaaaaaattggaacacttattagatgaatcatttgagctaggagaga

SEQ ID NO: 82298 - DNA, 294 bp, Homo sapiens
  misc_feature (274)..(274): n is a, c, g, or t
caaaaatgccactttgctagtatccacacaaatgttttgattggcagttgtgagacttttttgctaatacatctattagaagtattgttttcaaatcctggttctgccatttagtagccgtgtgacttttggcaagtggtttaacctcaggttttcatctgtaaaatgaaggttagtgagtaattgtatttatttatatttttttatttttgagatggagtttcactcttgttgcccaagctcatgtcattgcactccagcctgggcaacaagngcaaaactccctctcaaaac

SEQ ID NO: 82299 - DNA, 517 bp, Homo sapiens
ttgtgggagttcagtcaggctggtgggaaaaactttaagatgaagttataggatatagacacaaatcttcttggaaggctggaaggttttgcaaaagtctcaggatagggttatggctgaaagctgcctaatccttaccttgagtaaatggcttaaagtaggtacaaaggaatgcagtttatctaaatagcttgtttactcatgtgatcctaagaccaacctttgatcaacctcgggtgcataactgctctctactaggggtgtcgggaaccaggtcaattttcctatagtggtgtttactcaaagcctttgtcattgaatgtgtgctgaataaatgccggcagggccagtgagtcagggcctcggctgcaactctttacagcactctccttggagtctgtaagtggcgcagatgctcagctggactgacaggcatactatctgtgtcagtgtatgttattcatttgttgctgggtcagggtctgtgagttagatccccgcagtgcatacatgtctt

SEQ ID NO: 82300 - DNA, 152 bp, Homo sapiens
gtgacatttttacaccctaaaagggcagttgcaaacttgtgaaattttaaggtatagtgatagtgtttttctaagaggaatgaggttaaaaaaaaatttttaactgaataaaattcaaaataaagcacttaactgtgccaatgttagaaaaa

SEQ ID NO: 82301 - DNA, 229 bp, Homo sapiens
accgcacccagccagaacagactcttttacgtctggtaacaaacatttacactcattgttctctccctccaaagcctgttacctggaggcttcacctgcataaaaccttggtctccacaaccccttatctcaacccagatgttccaaagtttttagacgataacgtaactctttcagccaattaaaaaaaaatttttttcttttgacacagagtcttgctctgtcacct

SEQ ID NO: 82302 - DNA, 428 bp, Homo sapiens
gtgtacatttcagctatcgtagtgtcagctctttggtatctctttgtttttatgtccactatgttttgttgatgtctcctcttagtggttggtcagtaaatctgcctacctactgtttttttccaagcttagtgctgattttgtatatatatttgcttaaaatgacaactcaactaccccaaacacaatatagattatataaatttgagtactagatttcacgtgttttattctagcatagacagttcgttagtttttcatcaaagcttctttatccttagaataaacaattctagcatatcataaatcattctaacccagagaaaattagaaaccatgaagcagataaacaatatagttagctagaagagtgtgaactacctgacagcctgataataagagaggagaaagggaagaaacataaactt

SEQ ID NO: 82303 - DNA, 747 bp, Homo sapiens
cggtggacccctccttgtccagcacgctgcctcccgcctgctgcgacctcactctcttctgctgtcctgggacctcgtgggcctcctcccgggtccccttcctgctcctcatcctctgtttggccgtctggttgttagagcgctccccaggcctcaggaggatgaggaataaatgaaccaccccggtcccccaggctccccttcattcattcaaccagcgagtgttcccagggagctcactgtggatggggctccccatgggagctgcagacacagcagggagcaaagccgcccccgcctcctgagctcacctcatggtgggagacaaaatgcaaataaatgcatcgtgtccaggagtgcaacgtgctgtaaggaacataaaccagggaaagggcagagagtgtggggcagtggggccagtctgaatggaaggggagggctgtctgctcagctgtcatctgagaagcctggacagagtggggcacacgatcctctgatggacgagcccctgcaggcagaggaaacagccgtgcaaaggcccccaggcagcagcgagctcttgcaggaaggcctgtgaggctgcagccaaatgggcaaggtcagagtgaggagcagaggccagaaccacagggagggagcggccagaccctccacggccttagggcgtccctgagattccatcaggaaagggatgtaatcggatcaccccgggaacagtgaggaaaattgactccaggaggtcagggg

SEQ ID NO: 82304 - DNA, 716 bp, Homo sapiens
tcaaccccttgcctaggactgttgatattcatgaacccacttaaagacctgaaaacaattataagctccaaaatgaagacatccgcaatgccaacacgattaactgcgtaattgaatatgtataaaataccacatgttgtcactttattcttaaatttaatattcaagaaatcactataacactttagaataatttgtaggatatattttcttcttttgaaaggtttccagagtgtgcgtgagcaatatcattgccaatagttaattaaatgagtgacttgtagcctcgtcatttcaaaagcaaaattataaaaattctttcaagttcttttggagcaaaagtagatttttatgtgagatgtggacatattttaatatttttggtatgatatgggatggggcctcataaacacacattcagagagtttaccaccaccgaatgcttttgcacagggcacacaattggaaaaaataaaatatgccattcaaagttgggtctttaacagctcaaagatggtgaaaggctttcagggcctctctccattgtgtgactgtctctgaagggtgtagtctacttcctgctacaccagaattgtccttagggaacttgaggacagtagattctactctgcctgaattcaggtgaggccaatggtgagctgctgcatccagttgcataggatgtgcactgtgtaagggcaccacataccaagggg

SEQ ID NO: 82305 - DNA, 131 bp, Homo sapiens
cagttaccccagaattccaggtccctatggctatgggcaaatgggctgagcacccccaggctaatgcctccaaaatctcccctttcgctatcttgaccaagttatgtaacacatgtgctaatatctttctt

SEQ ID NO: 82306 - DNA, 382 bp, Homo sapiens
atttcaaaaaacacacggtttcaaaattcttccactcatacaacttgtggttcatcaaactaagggaataaatcaagaatgaagatagcatgagattcagaaattggaggattcagtgcagaagagaggcaaaggtaatcccagaacaatgaagttgaagaaagggataacacctgaataccagtcccatacagcagccagtcctgagttttggaggagaagggaggattccaggggaaggtctttcagagaaaaaagataagttgcaataatggattatcctatatgttctattgtagagagttatagaagaattaatgacaagaacacagaaaattgtgcagttttcttgaagaggtgctcaattatacaaaaagaaaaa

SEQ ID NO: 82307 - DNA, 257 bp, Homo sapiens
cctattaccatgtgtagaaaacattgaagacttgtaagcaagtgagaatcatgaataggccctggttctctttagaaaatgtattacatttggaagctcaagagattgtattggtaatagtttgcattagggtggtgacgtaagggacatttaagagaactaacttatggttcagcgtggcagagtagagaggaaaatgtcaagggtaactcagatttcttacttgagcagtaaagtagatgatgtgccattggctg

SEQ ID NO: 82308 - DNA, 475 bp, Homo sapiens
ctggctggcttgtaaaaacccaggaaaaggttttgtgcctttatggtgaatgaaaaaaaggcaggatacacaattgtattatacattatgaccaggttaaaatgcctagaaaaccttagtatcaaacacaacaaaatcttaatgtcagttacctgtgtgaatcaggactgtcaggattttttattttctgttttatatttttctgtatttttcaagtactctgcaatgaagaggtgttatttctagcgtcagaaaaacaaaatcctttgtttagtacttgagaactaattgaactgtgggccccacccccttccctactctgtgtttcttctgggcccctggatctccctgccagggccttgttcccaggaggtggttgagaaatttcggtaaacgcatgacgtcttgcttgaagagtcagacaaataagtgattctagggcaggaaggagagccctagcccactctcaggtgga

SEQ ID NO: 82309 - DNA, 616 bp, Homo sapiens
ttcagcctcactggacttgactcaggggcaagaatcccttatccatgagcctaagccccacaccttgacctcccccatcatccacgtttgtggggcacaatctccctacatccccaggtaatattttccccaggtgagtgcctcaaggccttatgcaagtcatgagacctcagaagaactttcctgcccctctctgacctgccacctgcactcaggaggggacttcggcctatctggggcaaaaacactgtaatagtagcaagaggagccactgtcattacaccaagccctgggctcgtattaactgggctcccagccaagcaaataacctggcaggaaccagaaatctaacaatatcaactcttgttcctgaggcacttttcctttttcaaaacacattttacatcagttatttgatcctcagaataaacttgtgaaatactaccgtccccatttatagaagcaaaagatgaggcaaagagaaaagcagcctgcccaatgtcacacgagtctcccgggtcctgtttagggatctttccattgtacagcccttcctcactccccagagcagtgaggaagggtgtctggttcatttattcatgccaccaatgtcaga

SEQ ID NO: 82310 - DNA, 388 bp, Homo sapiens
aaagcagaaaggatataaagtttagtgtggaaatagagaattaaaaataattgagaaacacagcacttcgttgacttattcataaaataaagctttattaaaatgagaaatgtaaaacgtgatgttcctaatgaccttattccatacaagggattagtattttgacaaatatctttgtggaagtagacaaattcctagaaagacactgactaccacaactcattcaagaacaaagtgaagacaataaattggtaatttaaaaactctcacccctgcccctgacacacatgtaaattcccagttcaaatgtattcttttgtatattataccaaacacatgaaaattaccaattcgataaaaatgtcttaaaaacttggaagagcatgta

SEQ ID NO: 82311 - DNA, 369 bp, Homo sapiens
aacatgtcaaaaataactatattttataacaaaacatttagttaaaagaatggcaaatttctttaatacttgggttaggaggacacagctatactcatgtcttctgcatttaattcctcatggggtttttgaagtacatgaagaaatctagcctcatacaaatatgtagcaaaaaaaaaagacaagattatcttaatagccttttcagataagtgtggatagtcttctttgatgacttaccaaaatttgaaaaatggcaatttctgaaaggttggttgtgatgtgaaatctttgtttggtattctgttatattaaaaattaaaatcaattcatgtatcttgctatttgaatggatcttttacccatgta

SEQ ID NO: 82312 - DNA, 476 bp, Homo sapiens
ttgtgagccaggagggaagagaggctgttaggagattatttaatgggccaagttgcaggtagtagtgatgggaatgcagaggaaagcctctatggaatgaccaggtactgaccgcagtcaccctcctggatatttggctatggataaggagaaggagggatattcctaaaacaggtggaaattggaaaaaaaatccacaaatggaatctctcctttgtagaaggaggaacaggaatacatgcatctaacttataactcagatgattacaaggcaaacccttatttaaacatacactaaaagtcctcatgtaatatttgtccactttttgctttgagttatgcaagatgtgcttttgaaccactgccagcatcagatacttcctcactttctaactcacggcaagagagtgggcacctgctgtttcaggttggtttaatattggagggcgggcttttatgttcccagctggctcagc

SEQ ID NO: 82313 - DNA, 2672 bp, Homo sapiens
tccttcttcattctgcagttggtgccagaactctggatcctgaactggaagaaaatgtctatccaggttgagcatcctgctggtggttacaagaaactgtttgaaactgtggaggaactgtcctcgccgctcacagctcatgtaacaggcaggatccccctctggctcaccggcagtctccttcgatgtgggccaggactctttgaagttggatctgagccattttaccacctgtttgatgggcaagccctcctgcacaagtttgactttaaagaaggacatgtcacataccacagaaggttcatccgcactgatgcttacgtacgggcaatgactgagaaaaggatcgtcataacagaatttggcacctgtgctttcccagatccctgcaagaatatattttccaggtttttttcttactttcgaggagtagaggttactgacaatgcccttgttaatgtctacccagtgggggaagattactacgcttgcacagagaccaactttattacaaagattaatccagagaccttggagacaattaagcaggttgatctttgcaactatgtctctgtcaatggggccactgctcacccccacattgaaaatgatggaaccgtttacaatattggtaattgctttggaaaaaatttttcaattgcctacaacattgtaaagatcccaccactgcaagcagacaaggaagatccaataagcaagtcagagatcgttgtacaattcccctgcagtgaccgattcaagccatcttacgttcatagttttggtctgactcccaactatatcgtttttgtggagacaccagtcaaaattaacctgttcaagttcctttcttcatggagtctttggggagccaactacatggattgttttgagtccaatgaaaccatgggggtttggcttcatattgctgacaaaaaaaggaaaaagtacctcaataataaatacagaacttctcctttcaacctcttccatcacatcaacacctatgaagacaatgggtttctgattgtggatctctgctgctggaaaggatttgagtttgtttataattacttatatttagccaatttacgtgagaactgggaagaggtgaaaaaaaatgccagaaaggctccccaacctgaagttaggagatatgtacttcctttgaatattgacaaggctgacacaggcaagaatttagtcacgctccccaatacaactgccactgcaattctgtgcagtgacgagactatctggctggagcctgaagttctcttttcagggcctcgtcaagcatttgagtttcctcaaatcaattaccagaagtattgtgggaaaccttacacatatgcgtatggacttggcttgaatcactttgttccagataggctctgtaagctgaatgtcaaaactaaagaaacttgggtttggcaagagcctgattcatacccatcagaacccatctttgtttctcacccagatgccttggaagaagatgatggtgtagttctgagtgtggtggtgagcccaggagcaggacaaaagcctgcttatctcctgattctgaatgccaaggacttaagtgaagttgcccgggctgaagtggagattaacatccctgtcacctttcatggactgttcaaaaaatcttgagcatactccagcaagatatgtttttggtagcaaaactgagaaaatcagcttcaggtctgcaatcaaattctgttcaattttagcctgctatatgtcatggttttaacttgcagatgcgcacaattttgcaatgttttacagaaagcactgagttgagcaagcaattcctttatttaaaaaaaaaagtacgtatttagataatcatacttcctctgtgagacaggccataactgaaaaactcttaaatatttagcaatcaaataggaaatgaatgtggacttactaaatggcttttaattcctattataagagcatattttaggtacctatctgctccaattatatttttaacatttaaaaaccaaagtcctctacacttgatttatattatatgtggctttgctgagtcaaggaagtatcatgcaataaggcttaattactaaatgtcaaaccaaactttttctcaaaccagggactatcatctaagattaattacagtaattattttgcgtatacgtaactgctcaaagattatgaatcttatgaatgttaacctttccgtttattacaagcaagtactattatttctgattttataataagaaaatctatgtttaatcaactgaggcctctcaaccaaataacatctcagagattaagttatatattaaaagcttatgtaacataaaagcaagtacatatagtagtgactatatttaaaaaaacagagcataaaatgcttaaaaatgtaatatttactaaaatcagattatgggataatgttgcaggattatactttattgcatcttttttgtttaattgtatttaagcattgtgcaatcacttgggaaaaatattaaattattaacattgaggtattaatacattttaagccttttgtttttaaatttcttttgttccagagattgtttaaaaataaatattgacaaaaataatgttttatatcttaattctagtatctgttttatgcttgaaagcattacagatcatgatac

SEQ ID NO: 82314 - DNA, 334 bp, Homo sapiens
cggcacgaggacattgtaaagatcccatctctgacttgcttattggatcttccttgtctgcttgcagtggtgggatctttacaatgttgtaggcagacaaggaagatccaataagcaagtcagagatcgttgtacaattcccctgcagtgaccgattcaagccatcttacgttcatagttttggtctgactcccaactatatcgtttttgtggagacaccagtcaaaattaacctgttcaagttcctttcttcatggagtctttggggagccaactacatggattgttttgagtccaatgaaaccatgggggtaagtcttagatatatttgtca

SEQ ID NO: 82315 - DNA, 651 bp, Homo sapiens
gttgttctgcagaaaaacattaattattattattattggttttgagatttttgtttggtttttgtttttttgtttttcagaggcctttctttggagccctaaattttcttcaaggatggtctcattttactgaagagaaaattgatggcctaagaggttatgtgactttcccagtgatacatagccagtgactgacacaggcacagatagcttgcccagtcgcgtcccagggtccctcatctatagcttcctgcagttcctccctgcatgttgacctaaaaaagaacttaggagccaagacttaagaactctgcatttctggctgtttgaattctttcctgctcactgaggtttctgttatcttctctcctaggctgacacaggcaagaatttagtcacgctccccaatacaactgccactgcaattctgtgcagtgacgagactatctggctggagcctgaagttctcttttcagggcctcgtcaaggtgagatgatctagagaaaacttcacacgggagtgaacaaatgtttctttcaaagagattaagagttttcctaagcatgtgctctatttcgtagcatttgagtttcctcaaatcaattaccagaagtattgtgggaaaccttacacatatgcgtatggacttg

SEQ ID NO: 82316 - DNA, 320 bp, Homo sapiens
ggcgtgagcccgtgcctggccccaaaccgaaactcttagctcttaaaaactgagtccccattgtcccctttccctggtccctggcaaccttttttctactttctgtctctgtgaatttgcatatgctagatgtacctcatgtaagtagactcagacattatttatccttttgtgtctggcttattttacctagcttaatgttctcaaggttcatttgagttgtaccatgtgtcaaaatttggtacatatttttatattttatttttatattttatatatgtaattaatattttataaatattatatataatataaaatat

SEQ ID NO: 82317 - DNA, 382 bp, Homo sapiens
cccgtttggctaatggtgatgataaagagaggtgaaatctcttgcaaaggatcaggcacaggttatctgaccctaaagcaaaagcccagatgtaaagtttcctcagtgatgtttaagtgccatagctatcaaaacatcactattacggaaattccacaggaaacttaactttgttattgtgaaattgaaactctccaacactctaagcctccctttccctcattggaacagtggtttttataatgggattttgcttttgtttttgtttctgttggtttttgtttttaatgttaggaaagacaattgttctgttccacagtcttaatcttgaatttgatatcaaacctcaaacccctctgtagacacaccatctacctcaagg

SEQ ID NO: 82318 - DNA, 122 bp, Homo sapiens
cttgtgttcacatgggcaggacctgacatggctctgcatccaccaggcttgtcctgagctcagctgtcccctctcagagcgccacactccccctgggagctgctgccccgtatgccggggta

SEQ ID NO: 82319 - DNA, 819 bp, Homo sapiens
ggcttatacatataatacagcagtttatggaaaaagactccatggtatggtggaaaaaacacttttctaacagagcaacctggatcccagtcctggtctgccacggtttagcaacatgaccatgggtaactcacaaaaacactgagtctcagtttcctcatctatgaagcaaaacatccttatctgaggagtttttctttgtcaaattactatatcaccatgaccaatgcatacatatgtattacatatgatagtgatacgattattcctttcatatagatagacagaagatatagatagaaaatagataatagaagatattgatggacgaaagaagatatagacatgaatagatgatagaggatatagacacgtatagttgtgataatgtagcatagttttttcccaaaatgtgataaaataaagaaatgtttgacctaaagacttcccattttattgaaaagtatgaaatatattgaaaaatacaataaaactaaactgagccaaagttgttgcagcaactttacaattgcctaagttaaagtcgttttcaaatacttaagtggcaatatgcactaaaaaatagaatctttgaaatacaaaattgaagaaatgatgcactgaaagttataaaattatttgtgaattaaaaatacataaaacaatgtagtgaattaatctttaaatgtaacatatatttattcacttatttatttcattggtattcgtgcagcacctactatgtgccagatgttgttctgggggtaccacaagagattaaaaagaataagtccaaaaaacaaaacaaacaaaacacac

SEQ ID NO: 82320 - DNA, 439 bp, Homo sapiens
agctacccttcacccaaaagaggggtgggggtgaacactcagacaatctgagagggggtagtctaatagagccatctggagaagggagtggcagagccagtctgtgctgaccagtctgtgtcccgggacgcatccccacccgtctgtccaaggctttgtcccaccagctgcagccagcagcctcagaacccaaaatgagggtagcatagataagactgctgagccccctttctgtggtctttcctttccatgacctagagaaaagagctttgctggagggagacccccaaaaagaattagggtgctaacatcccaccaaaagcatcatcccacccaaaatgttgcttttcattctatgtcaataatttaaggtggaatttctctcaccctgtggagatgaaagtggcaaaaggttgtcccagcagtgttgggggatggg

SEQ ID NO: 82321 - DNA, 396 bp, Homo sapiens
tgccatctcggactggtggcatggtcttgggagtggtggcatcctctcagatcagtgggtgccctcttggatcagtgggcaccatcttggtttggtttggtgggtgtcaactgacacagagccactgaagtctggctacttcatggctgaagggaggttatgagctgagtcaggatgagcaaggcagctggggtgtagcataaaagagatggttgtatcaccgtcctcctcctctggtctttggaagggtgcagtacacaccaggagggcatgctgagttgttgacttcccaatggaaacccagggcattggtggcacatcgagacaccccaggtttgggcccagaattccaaacacgctcagctgcccatctgggcagtcatgggccagcctgcc

SEQ ID NO: 82322 - DNA, 242 bp, Homo sapiens
tcggcctccctacgtgctgggattacaggcgtgagccaccacgcccagccccttcctagctttctgatggtcatgtttttagtctgtctccttagatctgcccactaagttgttttataaaatctgaaccttaacagataaatccactgcataagtttactgtatccctcctggcctccacaggtctgagtttctgagaccccctaaaccactgactgaagcatgtcctccattgcacagca

SEQ ID NO: 82323 - DNA, 843 bp, Homo sapiens
cttatatagataatgtatgtcataggcatacatggctcagctactgaggcaatcttctctctgtaaaattaaaataaaagttttgccagcaattaatctccttagccgttagaatagattatacaccagtccttggagtgcaaggaagtgagcatgtgagagtgtttgaagacctggcactaaatgattacaatgtcaccaggagagagctcagttacaaaatagtacagttggagcagcttatttcttctcaagtacaattactttgttctcagaaccaatgtaatcattggagcacgtttatttcttctttgttctcacattgtgagtatgtgttagcatgtagcctaatgcaaatatggtaaaatatattatatttgaagctagctagcaatagtttgatatattttcagatatgaagatataaaaaacaaataaaaaacttttaaaaagtcattgctaactttgtaaaaacgtaatatatactcaagactcagcctgctgggctcaggttctggccctggccccatcacagaacagctgtgtgacttcgatacaataacttaacctctctgagactatgtatcataatttataaaatgggaagagtgaaagtgtctacctcacaggtttgccatagagattaaatgaattaaccattattgataaatgttaataatggtgtctaatacatattgaatgtttaagtgtttgtttgcaagtattttcctgacatttttgaaatatatgtgttttatatgttccctaaacttttgtatatcttcttacctcatttattagccacaatttgatcatctgaattcctagctgaataactggtac

SEQ ID NO: 82324 - DNA, 546 bp, Homo sapiens
ttcagacttatgtatccaaccacctcctagacctctgtatctctatttgtcccacatatatcttcattatgtacaaaatagatcttatcttcccttgatcagttatcgactcctttcaatgcttcctcccaaacattgtttgaaccttcttctccttctcatccctactgccactgacttagcaataattttaaggccaggggttagccaactatatagcttgtgggttaaatccatcctgttgcctgtttttatagggtccgtgagctaagaatggttttaacacttttcaaggacgttttaaaactgtctttaaacaaaatattttgtaccatgaggaaattatatgacattcaaatttcagtgttcataagttttattcaaacagccatgttcatttgtttatgtactatgactgtttttgtgctacagcggcagagttgagtaattcgacagagaccatgtgaccacaaagcctaaaatactatctaattcttatagaagaagtttgttgttctttgttctatagtaaacaggatttttaca

SEQ ID NO: 82325 - DNA, 287 bp, Homo sapiens
cacaccttaacctctgaaagtgcagggattataggcatgagccaccatgcccagcctacttgtgctttttttaagtttggaatcctttgactcctttttgggctgccagaatcctactcgttatccaaggtttagttcagacaccgttcacttcgtagccttttgtctaagatcaggtatagttctatcacgccttccatgaacacctcctacctctctgtgaggattaatcaactctatgcttgtgctatagtgtcattttgtgcagcttgtgtctggtgtgttat

SEQ ID NO: 82326 - DNA, 442 bp, Homo sapiens
tctcccctcccccctgcacaaggcaggccaaggctggtctggagggctgccggggacacaggccacatccagacctctgaggggaagacccttcttggtctccgctccctctgccactgctgacctggtggacgaggaggagccccttgccttagcccggaaggcggccaccgtgggtgcctgtgaggagccaggggatgtggcgcagcttcgtgcagcacagctgtccgctggggtgggcgtgggggcaggcaggccatctcagagtcccccggatatcccttctcctctgctcccgaataactcagccctgctcagacagggccccacattccaaaacactttctccgttgccagaaagaaagcaagcccagtatctgcctacccaccagtgcccatctccaaagggcagggtacccgagtcctgtgcacaggcccatcg

SEQ ID NO: 82327 - DNA, 296 bp, Homo sapiens
atgggggttccctcttatgtggtttattaatgtgttcagaaaacggggtaacttattgaatagagatgcatgcagtgtttctcaaggggagtcaggttgggaattgttttaagtagatgttagatggggtgcttattttgttccacgtaaatgcgtatagccaataaaagttcatagatcgatgtactttaaactttttgtcagctgagttccaaggaaccatgtaccactgatacctgctgcttgctcttttctggcatcagggtgactccaaatcttctagcagcacattccca

SEQ ID NO: 82328 - DNA, 464 bp, Homo sapiens
ttatattctcaatcataacactttatttcctgtatagcacatatcaaaatttgtgatcatttcatttgttgaatattttacctcgtggcaaaatcacacgccatcctccaaggggcgagacccctcagtgtgaaaggggcaagagacacagaacaagagtgacaaacgcataggaaagcccagaggccgctgccttgaccacagtgggtcggtctgagcagttcagtggttaggtctcttaaccaagaaagatagagcaaaccattcatgctcatgctggacttctggtttccttctttttagtcaactaggttcaaccctgatggtccaagaaggatatgccattttcatcctaagaacctctctaggaaccccaagtgggctccccacttggtatttttgctaagcaatcactgttggggggggtacaattacaggcagaaaggatctgagccccacccctc

SEQ ID NO: 82329 - DNA, 3365 bp, Homo sapiens
gtaggaatcgcagcgccaacggttgcaaggcccaagaagccatcctgggaaggaaaatgcattggggaaccctgtgcggattcttgtggctttggccctatcttttctatgtccaagctgtgcccatccaaaaagtccaagatgacaccaaaaccctcatcaagacaattgtcaccaggatcaatgacatttcacacacgcagtcagtctcctccaaacagaaagtcaccggtttggacttcattcctgggctccaccccatcctgaccttatccaagatggaccagacactggcagtctaccaacagatcctcaccagtatgccttccagaaacgtgatccaaatatccaacgacctggagaacctccgggatcttcttcacgtgctggccttctctaagagctgccacttgccctgggccagtggcctggagaccttggacagcctggggggtgtcctggaagcttcaggctactccacagaggtggtggccctgagcaggctgcaggggtctctgcaggacatgctgtggcagctggacctcagccctgggtgctgaggccttgaaggtcactcttcctgcaaggactacgttaagggaaggaactctggcttccaggtatctccaggattgaagagcattgcatggacaccccttatccaggactctgtcaatttccctgactcctctaagccactcttccaaaggcataagaccctaagcctccttttgcttgaaaccaaagatatatacacaggatcctattctcaccaggaagggggtccacccagcaaagagtgggctgcatctgggattcccaccaaggtcttcagccatcaacaagagttgtcttgtcccctcttgacccatctccccctcactgaatgcctcaatgtgaccaggggtgatttcagagagggcagaggggtaggcagagcctttggatgaccagaacaaggttccctctgagaattccaaggagttccatgaagaccacatccacacacgcaggaactcccagcaacacaagctggaagcacatgtttatttattctgcattttattctggatggatttgaagcaaagcaccagcttctccaggctctttggggtcagccagggccaggggtctccctggagtgcagtttccaatcccatagatgggtctggctgagctgaacccattttgagtgactcgagggttgggttcatctgagcaagagctggcaaaggtggctctccagttagttctctcgtaactggtttcatttctactgtgactgatgttacatcacagtgtttgcaatggtgttgccctgagtggatctccaaggaccaggttattttaaaaagatttgttttgtcaagtgtcatatgtaggtgtctgcacccaggggtggggaatgtttgggcagaagggagaaggatctagaatgtgttttctgaataacatttgtgtggtgggttctttggaaggagtgagatcattttcttatcttctgcaattgcttaggatgtttttcatgaaaatagctctttcaggggggttgtgaggcctggccaggcaccccctggagagaagtttctggccctggctgaccccaaagagcctggagaagctgatgctttgcttcaaatccatccagaataaaacgcaaagggctgaaagccatttgttggggcagtggtaagctctggctttctccgactgctagggagtggtctttcctatcatggagtgacggtcccacactggtgactgcgatcttcagagcaggggtccttggtgtgaccctctgaatgggtccagggttgatcacactctgggtttattacatggcagtgttcctatttggggcttgcatgccaaattgtagttcttgtctgattggctcacccaagcaaggccaaaattaccaaaaatcttggggggtttttactccagtggtgaagaaaactcctttagcaggtggtcctgagacctgacaagcactgctaggcgagtgccaggactccccaggccaggccaccaggatggcccttcccactggaggtcacattcaggaagatgaaagaggaggtttggggtctgccaccatcctgctgctgtgtttttgctatcacacagtgggtggtggatctgtccaaggaaacttgaatcaaagcagttaactttaagactgagcacctgcttcatgctcagccctgactggtgctataggctggagaagctcacccaataaacattaagattgaggcctgccctcagggatcttgcgttcccagtggtcaaaccgcactcacccatgtgccaaggtggggtatttaccacagcagctgaacagccaaatgcatggtgcagttgacagcaggtgggaaatggtatgagctgaggggggccgtgcccaggggcccacagggaaccctgcttgcactttgtaacatgtttacttttcagggcatcttagcttctattatagccacatccctttgaaacaagataactgagaatttaaaaataagaaaatacataagaccataacagccaacaggtggcaggaccaggactatagcccaggtcctctgatacccagagcattacgtgagccaggtaatgagggactggaaccagggagaccgagcgctttctggaaaagaggagtttcgaggtagagtttgaaggaggtgagggatgtgaattgcctgcagagagaagcctgttttgttggaaggtttggtgtgtggagatgcagaggtaaaagtgtgagcagtgagttacagcgagaggcagagaaagaagagacaggagggcaagggccatgctgaagggaccttgaagggtaaagaagtttgatattaaaggagttaagagtagcaagttctagagaagaggctggtgctgtggccagggtgagagctgctctggaaaatgtgacccagatcctcacaaccacctaatcaggctgaggtgtcttaagccttttgctcacaaaacctggcacaatggctaattcccagagtgtgaaacttcctaagtataaatggttgtctgtttttgtaacttaaaaaaaaaaaaaaaagtttggccgggtgcggtggctcacgcctgtaatcccagcactttgggaggccaaggtggggggatcacaaggtcactagatggcgagcatcctggccaacatggtgaaaccccgtctctactaaaaacacaaaagttagctgagcgtggtggcgggcgcctgtagtcccagccactcgggaggctgagacaggagaatcgcttaaacctgggaggcggagagtacagtgagccaagatcgcgccactgcactccggcctgatgacagagcgagattccgtctt

SEQ ID NO: 82330 - DNA, 1425 bp, Homo sapiens
gccggccctcccggaagcgcagagctccgctggtgccacgtttatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcc

SEQ ID NO: 82331 - DNA, 1466 bp, Homo sapiens
  misc_feature (1441)..(1441): n is a, c, g, or t
  misc_feature (1449)..(1449): n is a, c, g, or t
  misc_feature (1452)..(1452): n is a, c, g, or t
gccggccctcccggaagcgcagagctccgctggtgccacgtttatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtccaaaaaaaaaagtcgancggccgcnaanttagtagtagtagt

SEQ ID NO: 82332 - DNA, 919 bp, Homo sapiens
  misc_feature (823)..(823): n is a, c, g, or t
gccggccctcccggaagcgcagagctccgctggtgccacgtttatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacaagctgagcagttctagtacagctgctggctgtcgcgtaccaggtgaggcgacgatctgtgngtagccttgcttatgccatgctgtctgcactacagtaggctagagacatatagaggatcgctgatagtgcacctggcatacactagcaggttactg

SEQ ID NO: 82333 - DNA, 165 bp, Homo sapiens
gcggccgcctactactactactgctcgaattcaagcttctaacgatgtacggggccatgcaagcaggacagaatggtgactgggtgcccttggtgagctgtgtatttcctaggaggtagaaaactgtgggaaactgtggctaataaaaactaagtgtgagcgtcc

SEQ ID NO: 82334 - DNA, 2071 bp, Homo sapiens
gccggccctcccggaagcgcagagctccgctggtgccacgtttatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtccaaaaaaaaaaaaaaaaaaaaaaaaaaaaaaaaaaaaaaaaaaacaaacaaaaaaacaaaacaaaaaaaagaagaggagggcggcggcgcgcgctgaacaagagagatttcccccgcgagaggagagcgcccacagagacgtcagcgagcgcacccgccgactttttgtgtgagcaaccaacggcggtgcgcccccatagaaggagcagcgcagctattaatacagcgcccgaggcgcgggggggggccgcgcgtgttgtaaaccaaccgagcgccgcgcagcgagagaggcaaaaacgacagcgcgcccgaccgcggggaaactatcgggggggaggaagagagaaccaccactatcagcgcgggggggggggggggagaccacagctgggggggccgcaaaatcccccatcttctccacgaaagattaatatagaagaccagccgcgccgggggggagacataaatgatctaaaacaaatctttctctacaaaggaggagcgtctagagtgagtgcgtgtgtacaaaaccaccacacgcgggatatatatgaagtcgccgtcagcgctcgagagaataatattgtgcgccctcagcaaggaacagccagctacacattctggcacaaaaatttttttttcacgga

SEQ ID NO: 82335 - DNA, 1465 bp, Homo sapiens
gccggccctcccggaagcgcagagctccgctggtgccacgtttatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcctcagagccaggcctaagttcagagcacagggtaccgagcc

SEQ ID NO: 82336 - DNA, 1410 bp, Homo sapiens
gccggccctcccggaagcgcagagctccgctggtgccacgtttatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgccctggctttctcgatcccaccctacgggtttccattgcgtcggccctgccccaccactttcag

SEQ ID NO: 82337 - DNA, 1194 bp, Homo sapiens
gagtctgatcacagtgtctggttggcatttggtaagtggtggttgctcctttgataacagcaatttttttatggttgtcaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcc

SEQ ID NO: 82338 - DNA, 1015 bp, Homo sapiens
ccgcccgcctctctacctccaagcctctattcgccctctcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcc

SEQ ID NO: 82339 - DNA, 1370 bp, Homo sapiens
gccggccctcccggaagcgcagagctccgctggtgccacgtttatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacaggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcc

SEQ ID NO: 82340 - DNA, 1480 bp, Homo sapiens
gccggccctcccggaagcgcagagctccgctggtgccacgtttatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcggggaaatgcccccagggaacccgggggcccccgaaagcccgcggaaaaagaacccctttttaaatttaaggcccggaaaaatttcctaccctttttataaccctggctggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcc

SEQ ID NO: 82341 - DNA, 939 bp, Homo sapiens
tgatgaattcttccaggagtcaggaaggcttcacttgaaaatgtagaagcttggccttctaggtgaagagaacagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcc

SEQ ID NO: 82342 - DNA, 529 bp, Homo sapiens
ctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtccgtcctggagacttgtgcctttat

SEQ ID NO: 82343 - DNA, 841 bp, Homo sapiens
atctgccattcgattcctaacacagggagtggagttggagtgagagaacatgaagccagctctacaatttttgcattgtataatgttttccacgaacttggcagaagcccacaaaggaaagacagttggtgcttaggagctagccttgattttctgcttgggacgggattccagttttgaatgtttcccaagatgtgtttcacgggagagtttattttgtctacagtatccccaaggaagcttgtggttaatgatgtgctcctgcaggcgcctggcagccaaggggaccagaagaacagaagaggcgccctgattggctcctgggattacagctttattaatgcgctctgacagcctgtctgtcactagcgccaagcggagaacattaacttgaacctgacagctccaccccccagagaaaatgagggcctaatgtgttataaatcaagctggcttttgaaatcaatattcctaaaaaaatactactggaagaaaacacattcctattactcagagtgttgacatatttattaaagtagcataaaggccactgagttagtcactaaaaaatagaaatgaaaatgtgactatcaattgaaacttagacgtttctacctttatgtttctcttttttttttttttctgtatcaggttcacacattgcaaagtaaatgggagctatttagcaaatggccagttcctttcatcaatggagtatgaaattctggtagctcaaggctcaaggctcaggttttgaataggcaccatttttggctgactactttgcctaaatcatgcagtgctcaatagacctgaatgtagatagactgtacactaagaa

SEQ ID NO: 82344 - DNA, 352 bp, Homo sapiens
aggtgcctgtagtcccagctactcgggaggctgaggcaggagaatggattgaacctgggaggcggagcttgcagtgagcccagattgcgccactgctctccagcctgggcgactgagcgagactcgtctgaaaacaaaaacaaaaacagaattgcatggcctcattggtattttgtcaaagccgtctttgccactaaggtgcaaatatcattctaaattaactataactctcctctggagagggacagatatgaatgacataaactctctttgtttaaatgttttcagttataaaatatgtaaattgaaaaatgttaaaatttataaataaagcctactttgtatttttgta

SEQ ID NO: 82345 - DNA, 514 bp, Homo sapiens
gaggactgaggaacaggaacactccttcagcttagttatgtagatattcccacagccctgcctcaagctctttctttgtaccctagaactctacagcagcctcgctgctgggcttttctggtcccccaaccatcaagcatcccccttgcccttttcccttatgttctacaaatatgggatccttcttgccacaagcattgtcctcaaggctccctgtgccttggattgctatcatgtacccccatcatcacctgattctcccgtactcagccttcaggtctctgctgaaagtcatgtgctcagggaggcatcccttaatccccccatcctcactcacctgtctctattggaacccctgtggcagtgcctgctcctttacatttcttgttcagattcctcttctgacttccccactgtcctctaggactcgcttagacagagatcgtctcagtcttgtcagtgttctgagtgcttagttccctgcctgatgcatagtgcgaactcaatacgtaat

SEQ ID NO: 82346 - DNA, 3857 bp, Homo sapiens
cgcctggccggcgggctgaggcgtacgggtcgcacgcagcgccatgcgaggcccccctgcctggccgctgcggctgctcgagccaccgagccctgccgagccaggtcggctcctgccggtagcctgcgtgtgggccgcggccagccgcgttcccgggtccctatcgccgttcactggcctgaggccggcgcggctatggggcgcggggcccgcgctgctctggggcgttggagccgcgcgccgctggaggagcggctgccggggcgggggtccgggcgcctcgcggggcgtcctgggcctcgcgcggctcctggggctgtgggctcgcggccccggcagctgcaggtgcggggcttttgccgggccaggcgctcctcggctcccgcgcgcccggttcccgggcggtcccgcagccgctgcctgggcaggggacgaggcctggcggcgcgggccggcggcgcctcccggggacaaggggcggctgcgccccgcagcggccggactcccggaggcccggaagctcctggggctggcgtaccctgagcgccggaggctggcagctgcggttggatttctcacgatgtccagtgttatctccatgtctgcccctttcttcctggggaagatcattgatgtcatctataccaaccccactgtggactacagcgacaacctgacccgcctctgcctagggctcagtgccgtgtttctgtgtggtgctgccgccaatgccattcgtgtctacctcatgcaaacttcaggtcagcgcattgtgaataggctgagaacttcattattctcctccattctgaggcaggaggttgctttctttgacaagactcgcacaggagaattgattaaccgcctctcatcagacactgcactcctggggcgctcagtgactgaaaacctctcagatgggctcagggccggggcccaggcttctgtaggcatcagtatgatgttttttgtctcacctaatctggccacctttgttttgagcgtggtgcctccagtgtcaatcattgctgtaatttatgggcgatatctacggaaactgaccaaagtcactcaggattccctggcacaagccactcagctagctgaggaacgtattggaaatgtaagaactgttcgagcttttgggaaagaaatgactgaaatcgagaaatatgccagcaaagtggaccatgtaatgcagttagcaaggaaagaggcagtcgcccgggctggtttctttggagcaactgggctctccggaaacctgatcgtgctttctgtcctgtacaaaggagggctgctgatgggcagtgcccacatgaccgtgggtgaactctcttccttcctaatgtatgctttctgggttggaataagcattggaggtctgagctctttctactcggagctgatgaaaggactgggtgcaggggggcgcctctgggagctcctggagagagagcccaagctgccttttaacgagggggtcatcttaaatgagaaaagcttccagggtgctttggagtttaagaacgtgcattttgcctatccagctcgcccagaggtgcccatatttcaggatttcagcctttccattccgtcaggatctgtcacggcactggttggcccaagtggttctggcaaatcaacagtgctttcactcctgctgaggttgtacgaccctgcttctggaactattagtcttgatggccatgacatccgtcagctaaacccagtgtggctgagatccaaaattgggacagtgagtcaggaacccattttgttttcttgctctattgctgagaacattgcttatggtgctgatgacccttcctctgtgaccgctgaggaaatccagagagtggctgaagtggccaatgcagtggccttcatccggaatttcccccaagggttcaacactgtggttggagaaaagggtgttctcctctcaggtgggcagaaacagcggattgcgattgcccgtgctctgctaaagaatcccaaaattcttctcctagatgaagcaaccagtgcgctggatgccgaaaatgagtaccttgttcaagaagctctagatcgactgatggatggaagaacggtgttagttattgcccatcgtctgtccaccattaagaatgctaatatggttgctgttcttgaccaaggaaaaattactgaatatggaaaacatgaagagctgctttcaaaaccaaatgggatatacagaaaactaatgaacaaacaaagttttatttcagcataaggaagcaattactggtaaacaatatgagactttaatgcaaaacagtgttgcagaaaaaaaactcagagactatgaaatacataaaccatatatcaagttatttgaaaaatacctatttttttccaaagtgtgtaaaagattgttttgaaacgtacctgttctcaagatctttttattcagagttttaataattgtaactttttaaatgtctatagcactgaagttattttcaggttttgtattttcttttcttgtggaatattttaattaatatagcatggcacctcattttcttttgcctgctgttaaagattgaagctattgtcaaatgacaactttaaaaaggcaattataaataaaaagcctgattattttaggccagtttaccaatcactgtgtaattcttctggtagtattctacctacttttaagtctaattttacagatagaataatggaaattgaaaatttaaccctttattccgataatctcatgaagcaaacctaactatttaacatcagctggaaagaagggaacatttatattgcccatctcctgtgtcttcaaaggtgtgagagctgaggaatatgtgttcctatgggaactatgtttgaatatgtgcagttttcaacattttggcacatgaaagcctgacaagtttttaaaagggcagaagctttattttttgaacaggaaaacatgttttttaaattcacatgtttgtatgagtacttttgcgaagcaaggcatgaactgctaggtattattaagaatgaatgatttttgcatttaagttgtttgaaggcatgtattttgaaaaatatctgttacaaatttataatttcaagacaaattgaatcttattttataatacttttggaatttcattaataaggctaaaatttgaggaatataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaacttta

SEQ ID NO: 82347 - DNA, 3436 bp, Homo sapiens
gacctcaggtgatctaccctcctcagctcccaaagtactgagatacaggcgtgagcaccacaccccacccgataatggggttttttggtggcttcaccatcttggtcattttgatgggacgtgttgctgtggttgttcagtgcctgcaggtggttcagacctgaatatacaactcctgaggtggactggagcgtggagcagaatgggcctctgccaaacccccatcctgtctcttcccactctgttgttaaaccgcgtggtctgatctagtattggcctgaggattctttcttcagcaatttcttgtcacatttcttctatgtggcatgctgaatatttatggggttttgtgaagaataaagatgtctgtaaaattccatcaaaacaggatgtaacaacttggggacagtaccttcaagcctgctgttaatttaaacacacacacacacagacacacccacacacactcccctttcgtaggtaatgagaatgtcttgccacccaatgtaacaaacacctctgaattttttttgtttttgacagttttttgtctcacctaatctggccacctttgttttgagcgtggtgcctccagtgtcaatcattgctgtaatttatgggcgatatctacggaaactgaccaaagtcactcaggattccctggcacaagccactcagctagctgaggaacgtattggaaatgtaagaactgttcgagcttttgggaaagaaatgactgaaatcgagaaatatgccagcaaagtggaccatgtaatgcagttagcaaggaaagaggcagtcgcccgggctggtttctttggagcaactgggctctccggaaacctgatcgtgctttctgtcctgtacaaaggagggctgctgatgggcagtgcccacatgaccgtgggtgaactctcttccttcctaatgtatgctttctgggttggaataagcattggaggtctgagctctttctactcggagctgatgaaaggactgggtgcaggggggcgcctctgggagctcctggagagagagcccaagctgccttttaacgagggggtcatcttaaatgagaaaagcttccagggtgctttggagtttaagaacgtgcattttgcctatccagctcgcccagaggtgcccatatttcaggatttcagcctttccattccgtcaggatctgtcacggcactggttggcccaagtggttctggcaaatcaacagtgctttcactcctgctgaggttgtacgaccctgcttctggaactattagtcttgatggccatgacatccgtcagctaaacccagtgtggctgagatccaaaattgggacagtgagtcaggaacccattttgttttcttgctctattgctgagaacattgcttatggtgctgatgacccttcctctgtgaccgctgaggaaatccagagagtggctgaagtggccaatgcagtggccttcatccggaatttcccccaagggttcaacactgtggttggagaaaagggtgttctcctctcaggtgggcagaaacagcggattgcgattgcccgtgctctgctaaagaatcccaaaattcttctcctagatgaagcaaccagtgcgctggatgccgaaaatgagtaccttgttcaagaagctctagatcgactgatggatggaagaacggtgttagttattgcccatcgtctgtccaccattaagaatgctaatatggttgctgttcttgaccaaggaaaaattactgaatatggaaaacatgaagagctgctttcaaaaccaaatgggatatacagaaaactaatgaacaaacaaagttttatttcagcataaggaagcaattactggtaaacaatatgagactttaatgcaaaacagtgttgcagaaaaaaaactcagagactatgaaatacataaaccatatatcaagttatttgaaaaatacctatttttttccaaagtgtgtaaaagattgttttgaaacgtacctgttctcaagatctttttattcagagttttaataattgtaactttttaaatgtctatagcactgaagttattttcaggttttgtattttcttttcttgtggaatattttaattaatatagcatggcacctcattttcttttgcctgctgttaaagattgaagctattgtcaaatgacaactttaaaaaggcaattataaataaaaagcctgattattttaggccagtttaccaatcactgtgtaattcttctggtagtattctacctacttttaagtctaattttacagatagaataatggaaattgaaaatttaaccctttattccgataatctcatgaagcaaacctaactatttaacatcagctggaaagaagggaacatttatattgcccatctcctgtgtcttcaaaggtgtgagagctgaggaatatgtgttcctatgggaactatgtttgaatatgtgcagttttcaacattttggcacatgaaagcctgacaagtttttaaaagggcagaagctttattttttgaacaggaaaacatgttttttaaattcacatgtttgtatgagtacttttgcgaagcaaggcatgaactgctaggtattattaagaatgaatgatttttgcatttaagttgtttgaaggcatgtattttgaaaaatatctgttacaaatttataatttcaagacaaattgaatcttattttataatacttttggaatttcattaataaggctaaaatttgaggaatataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaacttta

SEQ ID NO: 82348 - DNA, 2106 bp, Homo sapiens
agttgaaaaccagtgggcagactgagtcctagttgagagttctaggtccacttcagacatggttgccatcaatcctaatcactctgtaagctgtaactgtgcagaatgcttttctccttacatcacagtatagttttatggagatcagaaagtcctaaacagttgaaattttgatcatggtaaaaattcattgctcaggaagggctgctgtgtgtatcaggaagcacatgggtgtcactgacgtctttgctttcttgtgtgtgtgctcctgtgtcagtgcgctggatgccgaaaatgagtaccttgttcaagaagctctagatcgactgatggatggaagaacggtgttagttattgcccatcgtctgtccaccattaagaatgctaatatggttgctgttcttgaccaaggaaaaattactgaatatggaaaacatgaagagctgctttcaaaaccaaatgggatatacagaaaactaatgaacaaacaaagttttatttcagcataaggaagcaattactggtaaacaatatgagactttaatgcaaaacagtgttgcagaaaaaaaactcagagactatgaaatacataaaccatatatcaagttatttgaaaaatacctatttttttccaaagtgtgtaaaagattgttttgaaacgtacctgttctcaagatctttttattcagagttttaataattgtaactttttaaatgtctatagcactgaagttattttcaggttttgtattttcttttcttgtggaatattttaattaatatagcatggcacctcattttcttttgcctgctgttaaagattgaagctattgtcaaatgacaactttaaaaaggcaattataaataaaaagcctgattattttaggccagtttaccaatcactgtgtaattcttctggtagtattctacctacttttaagtctaattttacagatagaataatggaaattgaaaatttaaccctttattccgataatctcatgaagcaaacctaactatttaacatcagctggaaagaagggaacatttatattgcccatctcctgtgtcttcaaaggtgtgagagctgaggaatatgtgttcctatgggaactatgtttgaatatgtgcagttttcaacattttggcacatgaaagcctgacaagtttttaaaagggcagaagctttattttttgaacaggaaaacatgttttttaaattcacatgtttgtatgagtacttttgcgaagcaaggcatgaactgctaggtattattaagaatgaatgatttttgcatttaagttgtttgaaggcatgtattttgaaaaatatctgttacaaatttataatttcaagacaaattgaatcttattttataatacttttggaatttcattaataaggctaaaatttgaggaatataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaacttta

SEQ ID NO: 82349 - DNA, 365 bp, Homo sapiens
cactagcgcccacagtctgtagttaataagagaaaagtagtgttagtagtgcatgacagttaatgtgcctggtttgggaaagtctctttccacccatgggatacagtgcagcagacacgctcagaggctgcattgctcaggagggttacaactccaggccaagctgctgcacagtaagtggctgccccataatggtaatggatgtctttacccttggtgagcctgttcgtgtttgcttttgcaggtcagcgcattgtgaataggctgagaacttcattattctcctccattctgaggcaggaggttgctttctttgacaagactcgcacaggagaattgattaaccgcctctcatcagacactgc

SEQ ID NO: 82350 - DNA, 3812 bp, Homo sapiens
cgcctggccggcgggctgaggcgtacgggtcgcacgcagcgccatgcgaggcccccctgcctggccgctgcggctgctcgagccaccgagccctgccgagccaggtcggctcctgccggtagcctgcgtgtgggccgcggccagccgcgttcccgggtccctatcgccgttcactggcctgaggccggcgcggctatggggcgcggggcccgcgctgctctggggcgttggagccgcgcgccgctggaggagcggctgccggggcgggggtccgggcgcctcgcggggcgtcctgggcctcgcgcggctcctggggctgtgggctcgcggccccggcagctgcaggtgcggggcttttgccgggccaggcgctcctcggctcccgcgcgcccggttcccgggcggtcccgcagccgctgcctgggcaggggacgaggcctggcggcgcgggccggcggcgcctcccggggacaaggggcggctgcgccccgcagcggccggactcccggaggcccggaagctcctggggctggcgtaccctgagcgccggaggctggcagctgcggttggatttctcacgatgtccagtgttatctccatgtctgcccctttcttcctggggaagatcattgatgtcatctataccaaccccactgtggactacagcgacaacctgacccgcctctgcctagggctcagtgccgtgtttctgtgtggtgctgccgccaatgccattcgtgtctacctcatgcaaacttcaggtcagcgcattgtgaataggctgagaacttcattattctcctccattctgaggcaggaggttgctttctttgacaagactcgcacaggagaattgattaaccgcctctcatcagacactgcactcctggggcgctcagtgactgaaaacctctcagatgggctcagggccggggcccaggcttctgtaggcatcagtatgatgttttttgtctcacctaatctggccacctttgttttgagcgtggtgcctccagtgtcaatcattgctgtaatttatgggcgatatctacggaaactgaccaaagtcactcaggattccctggcacaagccactcagctagctgaggaacgtattggaaatgtaagaactgttcgagcttttgggaaagaaatgactgaaatcgagaaatatgccagcaaagtggaccatgtaatgcagttagcaaggaaagaggcagtcgcccgggctggtttctttggagcaactgggctctccggaaacctgatcgtgctttctgtcctgtacaaaggagggctgctgatgggcagtgcccacatgaccgtgggtgaactctcttccttcctaatgtatgctttctgggttggaataagcattggaggtctgagctctttctactcggagctgatgaaaggactgggtgcaggggggcgcctctgggagctcctggagagagagcccaagctgccttttaacgagggggtcatcttaaatgagaaaagcttccagggtgctttggagtttaagaacgtgcattttgcctatccagctcgcccagaggtgcccatatttcaggatttcagcctttccattccgtcaggatctgtcacggcactggttggcccaagtggttctggcaaatcaacagtgctttcactcctgctgaggttgtacgaccctgcttctggaactattagtcttgatggccatgacatccgtcaggaacccattttgttttcttgctctattgctgagaacattgcttatggtgctgatgacccttcctctgtgaccgctgaggaaatccagagagtggctgaagtggccaatgcagtggccttcatccggaatttcccccaagggttcaacactgtggttggagaaaagggtgttctcctctcaggtgggcagaaacagcggattgcgattgcccgtgctctgctaaagaatcccaaaattcttctcctagatgaagcaaccagtgcgctggatgccgaaaatgagtaccttgttcaagaagctctagatcgactgatggatggaagaacggtgttagttattgcccatcgtctgtccaccattaagaatgctaatatggttgctgttcttgaccaaggaaaaattactgaatatggaaaacatgaagagctgctttcaaaaccaaatgggatatacagaaaactaatgaacaaacaaagttttatttcagcataaggaagcaattactggtaaacaatatgagactttaatgcaaaacagtgttgcagaaaaaaaactcagagactatgaaatacataaaccatatatcaagttatttgaaaaatacctatttttttccaaagtgtgtaaaagattgttttgaaacgtacctgttctcaagatctttttattcagagttttaataattgtaactttttaaatgtctatagcactgaagttattttcaggttttgtattttcttttcttgtggaatattttaattaatatagcatggcacctcattttcttttgcctgctgttaaagattgaagctattgtcaaatgacaactttaaaaaggcaattataaataaaaagcctgattattttaggccagtttaccaatcactgtgtaattcttctggtagtattctacctacttttaagtctaattttacagatagaataatggaaattgaaaatttaaccctttattccgataatctcatgaagcaaacctaactatttaacatcagctggaaagaagggaacatttatattgcccatctcctgtgtcttcaaaggtgtgagagctgaggaatatgtgttcctatgggaactatgtttgaatatgtgcagttttcaacattttggcacatgaaagcctgacaagtttttaaaagggcagaagctttattttttgaacaggaaaacatgttttttaaattcacatgtttgtatgagtacttttgcgaagcaaggcatgaactgctaggtattattaagaatgaatgatttttgcatttaagttgtttgaaggcatgtattttgaaaaatatctgttacaaatttataatttcaagacaaattgaatcttattttataatacttttggaatttcattaataaggctaaaatttgaggaatataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaacttta

SEQ ID NO: 82351 - DNA, 3963 bp, Homo sapiens
cgcctggccggcgggctgaggcgtacgggtcgcacgcagcgccatgcgaggcccccctgcctggccgctgcggctgctcgagccaccgagccctgccgagccaggtcggctcctgccggtagcctgcgtgtgggccgcggccagccgcgttcccgggtccctatcgccgttcactggcctgaggccggcgcggctatggggcgcggggcccgcgctgctctggggcgttggagccgcgcgccgctggaggagcggctgccggggcgggggtccgggcgcctcgcggggcgtcctgggcctcgcgcggctcctggggctgtgggctcgcggccccggcagctgcaggtgcggggcttttgccgggccaggcgctcctcggctcccgcgcgcccggttcccgggcggtcccgcagccgctgcctgggcaggggacgaggcctggcggcgcgggccggcggcgcctcccggggacaaggggcggctgcgccccgcagcggccggactcccggaggcccggaagctcctggggctggcgtaccctgagcgccggaggctggcagctgcggttggatttctcacgatgtccagtgttatctccatgtctgcccctttcttcctggggaagatcattgatgtcatctataccaaccccactgtggactacagcgacaacctgacccgcctctgcctagggctcagtgccgtgtttctgtgtggtgctgccgccaatgccattcgtgtctacctcatgcaaacttcaggtcagcgcattgtgaataggctgagaacttcattattctcctccattctgaggcaggaggttgctttctttgacaagactcgcacaggagaattgattaaccgcctctcatcagacactgcactcctggggcgctcagtgactgaaaacctctcagatgggctcagggccggggcccaggcttctgtaggcatcagtatgatgttttttgtctcacctaatctggccacctttgttttgagcgtggtgcctccagtgtcaatcattgctgtaatttatgggcgatatctacggaaactgaccaaagtcactcaggattccctggcacaagccactcagctagctgaggaacgtattggaaatgtaagaactgttcgagcttttgggaaagaaatgactgaaatcgagaaatatgccagcaaagtggaccatgtaatgcagttagcaaggaaagaggcagtcgcccgggctggtttctttggagcaactgggctctccggaaacctgatcgtgctttctgtcctgtacaaaggagggctgctgatgggcagtgcccacatgaccgtgggtgaactctcttccttcctaatgtatgctttctgggttggaataagcattggaggtctgagctctttctactcggagctgatgaaaggactgggtgcaggggggcgcctctgggagctcctggagagagagcccaagctgccttttaacgagggggtcatcttaaatgagaaaagcttccagggtgctttggagtttaagaacgtgcattttgcctatccagctcgcccagaggtgcccatatttcaggatttcagcctttccattccgtcaggatctgtcacggcactggttggcccaagtggttctggcaaatcaacagtgctttcactcctgctgaggttgtacgaccctgcttctggaactattagtcttgatggccatgacatccgtcagctaaacccagtgtggctgagatccaaaattgggacagtgagtcaggaacccattttgttttcttgctctattgctgagaacattgcttatggtgctgatgacccttcctctgtgaccgctgaggaaatccagagagtggctgaagtggccaatgcagtggccttcatccggaatttcccccaagggttcaacactgtggttggagaaaagggtgttctcctctcaggtgggcagaaacagcggattgcgattgcccgtgctctgctaaagaatcccaaaattcttctcctagatgaagcaaccagtgcgctggatgccgaaaatgagtaccttgttcaagaagctctagatcgactgatggatggaagaacggtgttagttattgcccatcgtctgtccaccattaagaatgctaatatggttgctgttcttgaccaaggaaaaattactgaatatggaaaacatgaagagctgctttcaaaaccaaatgggatatacagaaaactaatgaacaaacaaagttttatttcagcataaggaagcaattactggtaaacaatatgagactttaatgcaaaacagtgttgcagaaaaaaaactcagagactatgaaatacataaaccatatatcaagttatttgaaaaatacctatttttttccaaagtgtgtaaaagattgttttgaaacgtacctgttctcaagatctttttattcagagttttaataattgtaactttttaaatgtctatagcactgaagttattttcaggttttgtattttcttttcttgtggaatattttaattaatatagcatggcacctcattttcttttgcctgctgttaaagattgaagctattgtcaaatgacaactttaaaaaggcaattataaataaaaagcctgattattttaggccagtttaccaatcactgtgtaattcttctggtagtattctacctacttttaagtctaattttacagatagaataatggaaattgaaaatttaaccctttattccgataatctcatgaagcaaacctaactatttaacatcagctggaaagaagggaacatttatattgcccatctcctgtgtcttcaaaggtgtgagagctgaggaatatgtgttcctatgggaactatgtttgaatatgtgcagttttcaacattttggcacatgaaagcctgacaagtttttaaaagggcagaagctttattttttgaacaggaaaacatgttttttaaattcacatgtttgtatgagtacttttgcgaagcaaggcatgaactgctaggtattattaagaatgaatgatttttgcatttaagttgtttgaaggcatgtattttgaaaaatatctgttacaaatttataatttcaagacaaattgaatcttattttataatacttttggaatttcattaataaggctaaaatttgaggaatataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaactttatctgtgtctgtcactttttttttttttatgacccaggaaccaaagatgcagtctgtcatttcttataaaacttctcactacattgtttcttagtagaatttggctg

SEQ ID NO: 82352 - DNA, 1167 bp, Homo sapiens
agttaacataatgtatgatgatgatatctattccccaaggaatacaaagtgctttgcagaaattattttttaacctctgtccacttgtgagtcaaagtctacaggaaatggtgatagttccagtttgaaaaacagaagcaggcccagcatggtggctcacacctatgatcctaacactttgggaggctgaggcgggaggactgcttgaggccagaaactcgagtcagccagagcaacatacattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactactgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctccca

SEQ ID NO: 82353 - DNA, 1040 bp, Homo sapiens
  misc_feature (14)..(14): n is a, c, g, or t
  misc_feature (36)..(36): n is a, c, g, or t
  misc_feature (142)..(142): n is a, c, g, or t
  misc_feature (148)..(149): n is a, c, g, or t
  misc_feature (152)..(153): n is a, c, g, or t
ggcatcgggaaggngatcatggatcagtcgaaagtnttgagtcatataaagtggtctggagtaacacggagactgagctgaagacctgaccacttcgaactcagatcgtctgatagagagacataagcattgctatggcaanaaaagnnttnncaggaggaatgttgagtcattcacgcaaatgaacactttggccatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactactgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctccca

SEQ ID NO: 82354 - DNA, 640 bp, Homo sapiens
ttggcgaagctgagcgccggttaactcagctctaagttcgtaatcttagacctacctgtccactttatacgcctcatctctagtgaaaatacaaaaattagccaggcatggtggcgggtgcatgtattcgcagctatttgggaggctgaggcaggagaatagcttgaacctaggaggcggcagctgcagtgggttgagattacactactgcactccagcccaggtgacagagcgagactctgtcttaaaaaagaaaaaaattagagtccagaattttctccagatgctttgaaaaagctagacattctgtatacataaatgactaaaaagtttatagatgtagaaaaattaatacaggttttacatgtgcatttagtaaattcagaatttgaatttttctttttatttgcagctcagatcgtctgatagaagagacaataaggtaggaataagtttttgttttgctttgttggtttttgtttgtttgcacgtaaatttaatgaacagtgttacagctgttttagaattaaagaaaaaacattttaatgaacagatcaaagttcgtttatcctccttaaataaatttacattcttcttcaaaattgacccagtaattctatcttaataacgtctagtattc

SEQ ID NO: 82355 - DNA, 331 bp, Homo sapiens
agttaacataatgtatgatgatgatatctattccccaaggaatacaaagtgctttgcagaaattattttttaacctctgtccacttgtgagtcaaagtctacaggaaatggtgatagttccagtttgaaaaacagaagcaggcccagcatggtggctcacacctatgatcctaaagtgcagagattacaggtgtgagccactgcgcccagccacatttgtattcttaccatggatattggacctgtgctaaaagtactttgcatgcattattttatttgattttctcaataacccattagatagacacaaatcattaggaactatctccaa

SEQ ID NO: 82356 - DNA, 2038 bp, Homo sapiens
ataacccctaatcgcgtagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattgaagcctggttttcacaaggtggtatgtcatgataaaacaagccaaagaaaaggttgggtagtgtttggaggctaaaagagaccaaagagtcttagtgaatcaaccttgatgcgattagggtagtactaaccctaatcgcggacgttggacgacaaagatggcggcagggaccagcagttactgggaaggtgagggcgagaaggcctccggatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactactgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctccca

SEQ ID NO: 82357 - DNA, 1959 bp, Homo sapiens
  misc_feature (1102)..(1102): n is a, c, g, or t
  misc_feature (1108)..(1109): n is a, c, g, or t
  misc_feature (1112)..(1113): n is a, c, g, or t
ataacccctaatcgcgtagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattgaagcctggttttcacaaggtggtatgtcatgataaaacaagccaaagaaaaggttgggtagtgtttggaggctaaaagagaccaaagagtcttagtgaatcaaccttgatgcgattagggtagtactaaccctaatcgcggacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagagagacataagcattgctatggcaanaaaagnnttnncaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactactgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctccca

SEQ ID NO: 82358 - DNA, 1369 bp, Homo sapiens
ttggcgaagctgagcgccggttaactcagctctaagttcgtaatcttagacctacctgtccactttatacgcctcatctctagtgaaaatacaaaaattagccaggcatggtggcgggtgcatgtattcgcagctatttgggaggctgaggcaggagaatagcttgaacctaggaggcggcagctgcagtgggttgagattacactactgcactccagcccaggtgacagagcgagactctgtcttaaaaaagaaaaaaattagagtccagaattttctccagatgctttgaaaaagctagacattctgtatacataaatgactaaaaagtttatagatgtagaaaaattaatacaggttttacatgtgcatttagtaaattcagaatttgaatttttctttttatttgcagctcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactactgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctccca

SEQ ID NO: 82359 - DNA, 995 bp, Homo sapiens
ataacccctaatcgcgtagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattgaagcctggttttcacaaggtggtatgtcatgataaaacaagccaaagaaaaggttgggtagtgtttggaggctaaaagagaccaaagagtcttagtgaatcaaccttgatgcgattagggtagtactaaccctaatcgcggacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattataccacctgtattccatcaactccaagccaactttatgtctatacgcgcaacggcccaatcttatggactccctactaaagattcgctcagtttgcgt

SEQ ID NO: 82360 - DNA, 828 bp, Homo sapiens
ataacccctaatcgcgtagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattgaagcctggttttcacaaggtggtatgtcatgataaaacaagccaaagaaaaggttgggtagtgtttggaggctaaaagagaccaaagagtcttagtgaatcaaccttgatgcgattagggtagtactaaccctaatcgcggacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtataggtactaccagattctgtctcctatgccttaactgtgtttttaaagcattaaaaaataaactaaaatatataacttctgtaagttggtctattggtgaatttttggtgttttgttttgccattcattgtttta

SEQ ID NO: 82361 - DNA, 1150 bp, Homo sapiens
tggcttactgccttgtataaaaagatatcagagaacagtggagtcatttggaaaaagcgcagtggtaaagtggcttcggaagtgattttttccccttattttctggcacagtgctttctaagatgatgttgctcactgtagttttctttcacttttaaaggcatgatggttccaggcaggataatcttaaatggtgatttgtcatctttttttccccttgcagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactactgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctccca

SEQ ID NO: 82362 - DNA, 2016 bp, Homo sapiens
ataacccctaatcgcgtagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattgaagcctggttttcacaaggtggtatgtcatgataaaacaagccaaagaaaaggttgggtagtgtttggaggctaaaagagaccaaagagtcttagtgaatcaaccttgatgcgattagggtagtactaaccctaatcgcggacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactactgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctccca

SEQ ID NO: 82363 - DNA, 1559 bp, Homo sapiens
ataacccctaatcgcgtagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattgaagcctggttttcacaaggtggtatgtcatgataaaacaagccaaagaaaaggttgggtagtgtttggaggctaaaagagaccaaagagtcttagtgaatcaaccttgatgcgattagggtagtactaaccctaatcgcggacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggtaatatattgggctcgagatgttttcattatcacaggagtttgggtttttttttttaatccctgcattggatatgtgcacatatatttaaaaggacaaagagaaaaatctgagaaaataaatgccatgctaaagggacttgttttacttttttttggggtcaccattataaaattctgaaaatatctaatagctcttgctatttcttggcgaagttgagtaatattcatcactgggtacatatacttccactatgggagacctagctagctagctgtaacagtgaaatagccaatggtcatgtatagacaataacgtggtgggtaagcgtgtactttcagctagctttgaagataatatggagggggaattatttactatacttagtatattgtttaagaaaacagtaaatgtgtatgcaccaataaaactaaataaacttttaaagatttaaatggaggatatgttaaaaatatggtagtacaaatagaaaggactttctaaataagacttgatactggaaaccataacgaatggctaatttgcttactacacagagatataatagaaataagaaaaagacagtaggaaaatggacaaaggatataaaattgcttacaaaaaaatgaatggccaaaactataaaaacattttcagcagtatttcc

SEQ ID NO: 82364 - DNA, 1269 bp, Homo sapiens
ataacccctaatcgcgtagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattgaagcctggttttcacaaggtggtatgtcatgataaaacaagccaaagaaaaggttgggtagtgtttggaggctaaaagagaccaaagagtcttagtgaatcaaccttgatgcgattagggtagtactaaccctaatcgcggacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagccaccctaggaagggggggactccccatctagggggggtatttgggaccgggccctcccgctggtggtggatgggtcaatggtgggaaatttagggactttgcaagcacagtttata

SEQ ID NO: 82365 - DNA, 503 bp, Homo sapiens
agtcaaaacagattttctcttgtctcacgtccttccttttttaagctaaccgttcccattttctttcatcagctctatagtgagaggagacaccgtgctagcagccctcactcgctctggccgcgcttgaggagccctttaacccaccgctgcagtgtggaagcccctctctggactgccggagaccgtagccggctccctctgcttgcgggaaagtgtggagggagagacacgggtgggaaccggggctgtgcagggcactcatgggccagcgtgagttctgggtgagcacggactcggcaggccctgcactccgaacggccggcgccactggccccaggcagtgaaaagcttaacacccaggccagcagctgcggaggatgtgccgggtcccccagcactgcctgccggccggcccgcccgccccgcacttgaattctggccggacctcaagccgcctccctgcggggcaggggctggggacctgcagcccaccatgctcg

SEQ ID NO: 82366 - DNA, 265 bp, Homo sapiens
ttgtccgcgctttttcccctctgcacaaatagtagcacttctgtacctttcttatttttctttttaccaggtggtcttggtaaaggctgtacataagtgtttccttgatcttgctcttttttaaacaactgcacggtattcaactgtgtattatgttctataatttgttaataagtaccccattggtggtcatgaggttgtttccaattcttctttttcaaacattgctgcaataacttactgtgaactcacatcatttttcatg

SEQ ID NO: 82367 - DNA, 455 bp, Homo sapiens
tgaaactccatctttactaaaaatacaaaaattagccaggcatggtggtgtgcacctgtagtcccacctccccactagctgggactacgggttggcttggcttccatggctgtgggggcttctggttcatgccctttcctcctttctctcttgttcagtgttttcctccatagaatggctaaggccgtgccagccacctgaaaggagctgagttctagcctctactgattttgcgtgtgagctccttgccactccaaaatttttcttagccagagggccttgctgtcacttcttttgacttgctcatccatgctccctcagaaggtcctggggctcttcctttgatagccccttggcaagactgcaagctctgagctcctctcagctgcacccaaggtcttaattatcagaaagtttactcttcctgacaagggcttccatcttgccaaatattc

SEQ ID NO: 82368 - DNA, 395 bp, Homo sapiens
tgaaccctggtatccatttgaacaggtggctgaataagacagcttcagaaggggcagcagctgctgggagtggatggtgtcccagcacaatctggggttgtggtcatgaaaaacaaaataggaaatgatgtatacagtgaccttgaaagagttcatttttactaaattagtcccaaaaggaaaagggagaaatatttcagggcaccgtcaagcagccctgggtttagcaaggtgagcatgttttctgtaatgtggacactcaactggaatgtggcatgctaattttagaagggcaccagcctgttgaccgactttccattataatttacatgccgcctgcataactaccaggttatcaattgtgtattttgactcacatatttctttagattcaa

SEQ ID NO: 82369 - DNA, 592 bp, Homo sapiens
aacaagtgttcagaggtgccatgcagtaatgaaaccagtccaggagccaggctgtaagtgctgtaattcaagtaagcttttggttaatttaaagggatggtagttacaccagctcctaacccatcgccatcttctgtttcatgtttttgattactgagaagtgacactcaaatgtttattttttcttaaaactactgagtacattttgtaacagctccagtttctactgagagctcatttatgccatatttcctttgctcacataactctaagagtacttctgttttttactgaaagcttgtatttctgtctctgctaagttataaacttactgatgacaaaaaaaaaaacaaaaaaaaaaaaagaaaaaataaaaaaaacaagaaaaaacacaacaaaaaaaaaaacacgaaacaaagaaggaagaagacgagacgagaagagaggagaagacgagcagagagaacgagactagctctatggccgaccaacctcgtggcgttctccgctcggcgcgcgcgggtcgtgcgccgctccggcggttgggctcctgtccgatcgttcgatcgggtattctcggcgggctgtggcg

SEQ ID NO: 82370 - DNA, 712 bp, Homo sapiens
ctacatacccacatacacggacatagatttttttttcctttctattcatgcctggtcttgttcattccctagagtcttagccaagaatgtttgaaaggactagagggtgtcaaagcttagccatttattttgactgttcttgaatgagatacattatacactaataagtgagaatcaattaagcagaaattcggtctgcttaattggtacctcctagatttggctcctaggattagctgtagttttggagggtgaaatcaccaatcctctatgccagtgtccagttctcacaccatgtataaatactggtgtggtctagataagcaaagggtttgaaaactggtaaaccattcattgtacctaaatcagttttttggctaccatactacttggcatctgtaatctcaaagcatagtatcccctgtgctcaaactgaagaggaaattaagaaagtattgcgctgttcattggagccacttaaagtaattggcttagcttatctggtttgacttttccataaagatgaaattcatgtaatttgttaaatccttactacattatacgttgatgataatgtcttttccttgaatatgcttccattcttaattcatgatgatatttttgactttgtaatgattgatgtcctttcctcaccaccattcaccaagtggggcaaataaaaaggaaatctgcaaattttccgaagaaaggc

SEQ ID NO: 82371 - DNA, 660 bp, Homo sapiens
cagacacgggaagagagataaagctcagggatgtcttggcttcagaacaagccccactcatgggaacaaatccattcccatgggaactcaccctgtatcacaagaggagaatcactcccagcaccacggactccccagggagtcactcccacgacccacacgtctccctcccctcaggccccacctccctacgctgccacactgggggtcccgtttcaacaagagttttgctgggaacagatgcactgactacatccaggtcgtggtaagggctgtgcaagtatttgagtccctgctttgatttcttttggggatagacctaggaatggaatggcggcttcgcagggtaattttgtgtttacctgtttctggaaggagcacactgagctggccagagcaggcttgtgttttcctctgtgctccttcctgcttcccaggatgcagatgagatggcaggtgccccagcagccctcgccaaccataaggcatggattcctcaccttcggctcggggagcacagagactgagggccgtggactcggggtgagatggtggcacctccatcacagacccacagactctgtgtccagcccttccggaaaggtgacagaaatgaaaagtctgccttatggaagacaaggttattcagaattttcggtt

SEQ ID NO: 82372 - DNA, 1633 bp, Homo sapiens
tctaactttcagcaaatgtcaccctcattaaactccatctaattgtgcccagttccccaccctcctacaggggacaagaagtgtcccaacgcaaatagtgtatctggcagcctcataggactcaactggagtccggctccagccagtaaagggtcaactcagctctgaatgttgggagtttcacactgttaaggagaacgctgaggaggagatagcaaagaagaagttaggaaatgttggtgtctttttgcatttttccaaatgaaccttgtcactaaaatctctgcatacctttcatttaatctctattgcctattccacttttaacctgttcctctaagcataccactttagcctggattatgattcttttctttcttcacttctttgccttaaaattgttttttttaaaaaatcctgctactcatgttaccttgcatggttcagtttctcccttctaatactgccaacttccttaacccagacctcttatcgcaaagacaggagaatgtttttctatattgaagccaatagaaaactactaaaaggctacatgcaattagtaaatttttaaatgtacattttttaaatgagtgtaggaaacataaaactttagtaggtgcatgcttactgggaaagcacgcatgcatgctaaaatgtcattgtacagtacatattgtttaccacttgttttttagtttaatattacattatggatatcttttcaagttacatataatacctatatgtagctgacatacatttcactgcaagggtattgaattattttgtaactggccttagagggtttttacattgctgcttttttctttttttaaatactaccaactaaaagccataaactcttttctttttctttttttcttcactctgtactatgaaaaaagtttaagcatatataaaagtacaattgtactacttctaataaatccccacaaacctgtcacccagcttcaacattatcagattatggccaaacttgtttcacttacaactctactcatatcccatgcttttatatatatataattttaaagcatatctgagctagcatagtctttcaaatgtaaatatttcaatatttgctgtaaaagatatgaattttaaaaatgtaaacataatactattttcatacctaaacaattaacagtaattccttaatatcaattttccagttttctcaaagatgtcataaacttttttttgttcattttgttttttaacttatttgaatcaagatccaaggaagaaaacacattgtgatgggttgatatgtctcctaagtttcttttaatatatgggtaccctctcctgttttctcttccaactcacttgttaaagaaaatgaagttgtttgtcctgtagagttgcacacagcatgggttttgctgtctgcatcatgtgctatagtctaagatgttctgttgtcctctgtattttctgtaaattgtagtaatgtacaggcttgatcaaaatcaagttttaagtttttttgaccagataaatttaatgattttggcaagatggtgtgttctatttgaagcctattattttctgtttgtctctttttctgtggtgttagcagctattgatcctcaatacctatagccag

SEQ ID NO: 82373 - DNA, 1542 bp, Homo sapiens
tctaactttcagcaaatgtcaccctcattaaactccatctaattgtgcccagttccccaccctcctacaggggacaagaagtgtcccaacgcaaatagtgtatctggcagcctcataggactcaactggagtccggctccagccagtaaagggtcaactcagctctgaatgttgggagtttcacactgttaaggagaacgctgaggaggagatagcaaagaagaagttaggaaatgttggtgtctttttgcatttttccaaatgaaccttgtcactaaaatctctgcatacctttcatttaatctctattgcctattccacttttaacctgttcctctaagcataccactttagcctggattatgattcttttctttcttcacttctttgccttaaaattgttttttttaaaaaatcctgctactcatgttaccttgcatggttcagtttctcccttctaatactgccaacttccttaacccagacctcttatcgcaaagacaggagaatgtttttctatattgaagccaatagaaaactactaaaaggctacatgcaattagtaaatttttaaatgtacattttttaaatgagtgtaggaaacataaaactttagtaggtgcatgcttactgggaaagcacgcatgcatgctaaaatgtcattgtacagtacatattgtttaccacttgttttttagtttaatattacattatggatatcttttcaagttacatataatacctatatgtagctgacatacatttcactgcaagggtattgaattattttgtaactggccttagagggtttttacattgctgcttttttctttttttaaatactaccaactaaaagccataaactcttttctttttctttttttcttcactctgtactatgaaaaaagtttaagcatatataaaagtacaattgtactacttctaataaatccccacaaacctgtcacccagcttcaacattatcagattatggccaaacttgtttcacttacaactctactcatatcccatgcttttatatatatataattttaaagcatatctgagctagcatagtctttcaaatgtaaatatttcaatatttgctgtaaaagatatgaattttaaaaatgtaaacataatactattttcatacctaaacaattaacagtaattccttaatatcaattttccagttttctcaaagatgtcataaacttttttttgttcattttgttttttaacttatttgaatcaagatccaaggaagaaaacacattgtgatgggttgatatgtctcctaagtttcttttaatatatgggtaccctctcctgttttctcttccaactcacttgttaaagaaaatgaagttgtttgtcctgtagagttgcacacagcatgggttttgctgtctgcatcatgtgctatagtctaagatgttctgttgtcctctgtattttctgtaaattgtagtaatgtacaggcttgatcaaaatcaagttttaagtttttttgaccagataaatttaatgattttggca

SEQ ID NO: 82374 - DNA, 371 bp, Homo sapiens
ctaaacagatttaactccctcccagcaatccagattaatttaatatgctttcttaacggcattccgcatttctcattaaagcaaatgaacgtccatccctctctgataaattagggcaaaaaaattcatatgtttagggcatagggaaggaggagttgttggctgttaaaaaaaagaacaaaaaaaagtaccgcaaatggcgtttcaaagtctagacatcttcatcatcaacacaaacattcctcttcacaaagggacctcaagtaagcttaggctggagggcccacctgcgtatgcttttcttctcattctttcttaccttccctccagcccacccaacccacattcagtgaccaagtcacgtgggtttt

SEQ ID NO: 82375 - DNA, 415 bp, Homo sapiens
gctttcctctttccggggtctccagctttcagacagtagaatcatgagacttctcagcctccttaaccatgtgagccaatgccttataacaaatatcctacaaacatatatatataaatgtatacatacaaatataataatatcatacaaatatatatatttatatgtatacatgtaattacatttaagaacatttaaggctatttacatgtaaagaaaggaaaaataatgtaaatatttgttttcacctgaaataaatgtcagacactgtctttgtttaaagaaatagtcctcttaaactttgggcaatgctgccaattacattaacttacaatgttatttcaattgcatcaccagagtaaaatcttagagtattatttttatctaataaattaataacatccacatggcttta

SEQ ID NO: 82376 - DNA, 368 bp, Homo sapiens
cctgcttaacaatctttagaactattagaagcaatacctctgtttacatgtacctgtttccccaccaaagacataaaacgaggaaaataaaagcaaaaagcaaataaatatgtgaagtacacatacattcacactcaaccttggatttaatcaatcctgaatcattttgttaaatttatctaaatatatatacacatatatccacacacaggcacgtatagacatagactatgcattataatatattttaatttggaaacaacatttagacatttggctcaaagttacggaatattactatatctgacacgtttctgtttcaagaaatgtttacctaacatttttgagagttaaaaaaaatagttgtc

SEQ ID NO: 82377 - DNA, 389 bp, Homo sapiens
acccaaggctttactctcttggccagcatctgagctccccactctagtgtggtgggttgatgtgtgttttacctctgaggggctcactacagccctctctccttgaagatggagtgagctggtgggctatggaggagtgcttgtagaaaggaaactaaagctttctggacaaacagataaactcctagattcattcatttattcagtaaatatgtatgcatcctgattatatgctgggtactcctctgggtgctcatgaagcatcagtcactcaaacacatgaagcttgttgcttttgtgagcttccattctgcaggggaagatagacattgagcaataagcttaataaatacatcctatggtatgttaggaggtgataagtgctacag

SEQ ID NO: 82378 - DNA, 488 bp, Homo sapiens
gaaatgaagacacatcctgaactggaacaagacttgccaggggtgaactggcaaactttccttgtactaacttcacaatccaaaccacacgatgttatttcttatagtggctgtaaaggaagaagctgcagggcttaaatgtactcttttccagtttctggatttatctgtagtttacttttattttgtcgctttggtcgtgcattgaatgttctcttgactttcaaagatttgaaaatatatttaatatagtaattcagagggggtgaactcttgcatggtttgattaaaattatagccttaaaaagcattgttagttttagggcagatagcctttggattcaagtatatcttgtctttcatgtatcaattcaactgaccatttgaccttaaaagttggtatttttaattccgaattatttgtgtgctaccgtaaatcaggcgtattgcttgtcagttgttttttttctttttccttttcccttttt

SEQ ID NO: 82379 - DNA, 1001 bp, Homo sapiens
tggtacataactttttcttgttagcatttggtaggggtgttttattgaccaaatatgttcccacaacctagttttttgtaactgactaaatatagtagatttttaaattttatcatcaaaatctatagacaatttttgattaaaatagactccacatctatgtcctgcttttcttcttattattaattacattgttgtataaaagaacaagacttcagaatcaagaatatcttgtctcttggcattgaatttatacaaggtgctctttctttaatgctgtctcaaaggacatattttttactcattaaaaaggaagatcagaatctagttgtatgcattgctccaacatattagtaattaaaattaggaggtaaatgtggtcaaagcgatagaaagacttgagatgtcatttatattgattatagcactctacaaacagaaattgttaaataatagtttatataaatattttgtatcatttcaaatatttgagtgcctgaagtttctcctcttgtatagttcagattatcaatttgaagacttactccgttagttaaaatgtttctagtctcgtttattatataaaagcaattttcagttaaatgtgttccgcttacataaaacattacaaattagtgagtatttaattacattttcatgttcctgtaatgtctttagaagattttcatattattacctatcaatatatgtatgctttgtcaaagaaaaatcaaacatatatatcattgagattgaaactttttaaaagtacttaattctattgaaaaaccacatccataggaacaattgcaatataatattgggaacattaaatatatatcctatgtctattttatatataagcatatatgattaaaaatataaagatttttaaacgtagtattataaagtaaaaattagttaacttctgatgattatgttaattaagataaaattattctgattttggtgatttttaaataaaaatattaaattacatg

SEQ ID NO: 82380 - DNA, 384 bp, Homo sapiens
tgcctgcctggtattccattttgtgacttccataatttgagtgcaccttctcttattgatgaacatttacagttttccaaattttacagttattaataatctgtgataatccttacacatatgttttttatgttctcatactgttatttctgaaggacagaattttagaagtgggattgctgggtcattgggtatgtgcatcttaaattctaatagctgctgctaaataggcagaagcaatttgaagtcatgccagtattatgtgagaagaccagtttccatacatttaccaatatgtatttatctgcatttctccacgatcattgtagtaactgtatctttataacctgctggtttgtgtggtggtttaaaatttttcctctt

SEQ ID NO: 82381 - DNA, 102 bp, Homo sapiens
aggaagtggaggagggactgagagtaaggaaaagccccccgcttcccaactgcaggttactgagcctggtgtaggcctgagctggggaaagagagagccttt

SEQ ID NO: 82382 - DNA, 468 bp, Homo sapiens
caaatctattggttaatccatttgaatgccatcaacatgcctaagtattgtgtggtggatgctatgatgtgtcacacagaacttcttttaggatgacaggatggagtctccagctgtgaaagtgttgctgcagacagccctcagcttccagttcttgtaaaaatggcctcagcttcagagagctccattacccaagctcattcatttcctggggtgttctgcatccagtgagtgttctgtggacttgccagaacactcacttttggaacctggccaccatgttggaaggaatcccagagcacatgaggaggccttttgggggtgttccagctgacagccttagctaaggtcttagctaatagtcagcatcaactgctggcaagtgaacaaggcttcagatgattccagccctcagctttccagctgaaaacattgtaaagcaaatacagccatttccactttaaaaaa

SEQ ID NO: 82383 - DNA, 483 bp, Homo sapiens
aataaaaaagccttttagccaacaatatgtaagcagaagaatggagcaggagttagagagaaccctcaagcaataatggaggccactggagaggcaagactgccaaaggctaagttattgacccagtatttttaaaactgcctccgaaaagaagcctgaacgaaagaaaataatttgtgctattagaatgtatttttcctttgtgttcctatctacttccttcacaagctatttttggagcatttggccagagtgatctttctgaaatggaagactcatgtattgttcctgtgagtcagatgggaagctgatggaaagtcttcagcagagaaaaatccaaagtgactgcaatgatttacgtgactctacagatcctggcccctgtggtatcacctcccacctctctactcttcactgctgcactccagccatattggttccctcactttcttcacactcagtaagaatgctctacctcagggc

SEQ ID NO: 82384 - DNA, 389 bp, Homo sapiens
tacaaagaccgttgtaaagattgggaatgaggaaggtgaccttgatcgggtatccacagaccttacaaaatccttgtatgtaattagagttatgttaatggcacatttataagcaaagtaatgtcatggaatggaagacccataagttgacatgagaaacagaaagtgtattaaagttaatctgcattcatgggggcagattgttagccaaatgaataaagaattagattcatcttcatggtatgtagcatgaagaatttaaaatgaatcagaggtttaaattaactgcagaaattatagagtttcagaaaacgaatttctctccaattttgaggaaattactgatgatacacattgtagaagcaacaagaaaaacaaagattgatagt

SEQ ID NO: 82385 - DNA, 245 bp, Homo sapiens
ttcccgagtttttctggctacttaaaggcctttacatcttcaggtaaattttaggtgagtttatgaaatttaacaacaaaaaaattctgcttggattttgacattgaattgaatctatagatcaattttggggtgaattgccgtctttataatattgagtcttccaatcaatgaaaatggaatggccttcatttatttggaacaattatctcaccaatactttgtagttttagttgaatatgtct

SEQ ID NO: 82386 - DNA, 1747 bp, Homo sapiens
  misc_feature (84)..(84): n is a, c, g, or t
gcggcacgaggggggtgtctggctggcgtggctccctgtttggggcctctcccctgaatccttcctggggccatggaggccagncagacaccccggccagaatggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgcagaaatttgcaactcactgattctctacatgctctttttctgtgataactctgcaaaggcctgggctggcctggcagttgaacagagggagagactaaccttgagtcagaaaacagagaaagggtaatttcctttgcttcaaattcaaggccttccaacgcccccatcccctttactatcattctcagtgggactctgatcccatattcttaacagatctttactcttgagaaatgaataagctttctctcagaaatgctgtccctatacactagacaaaactgagcctgtataaggaataaatgggagcgccgaaaagctccctaaaaagcaagggaaa

SEQ ID NO: 82387 - DNA, 1774 bp, Homo sapiens
tcttcctacccatctgctccccagagggctgcctgctgtgcacttgggtcctggagcccttctccacccggatagattcctcacccttggcccgcctttgccccaccctactctgcccagaagtgcaagagcctaagccgcctccatggccccaggaaggattcaggggagaggccccaaacagggagccacgccagccagacaccccggccagaatggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgcagaaatttgcaactcactgattctctacatgctctttttctgtgataactctgcaaaggcctgggctggcctggcagttgaacagagggagagactaaccttgagtcagaaaacagagaaagggtaatttcctttgcttcaaattcaaggccttccaacgcccccatcccctttactatcattctcagtgggactctgatcccatattcttaacagatctttactcttgagaaatgaataagctttctctcag

SEQ ID NO: 82388 - DNA, 1631 bp, Homo sapiens
  misc_feature (84)..(84): n is a, c, g, or t
gcggcacgaggggggtgtctggctggcgtggctccctgtttggggcctctcccctgaatccttcctggggccatggaggccagncagacaccccggccagaatggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgcagaaatttgcaactcactgattctctacatgctctttttctgtgataactctgcaaaggcctgggctggcctggcagttgaacagagggagagactaaccttgagtcagaaaacagagaaagggtaatttcctttgcttcaaattcaaggccttccaacgcccccatcccctttactatcattctcagtgggactctgatcccatattcttaacagatctttactcttgagaaatgaataagctttctctcagaaatgctgtccctatacactagacaaaactgagcctgtataaggaataaatgggagcgccgaaaagctccctaaaaagcaagggaaa

SEQ ID NO: 82389 - DNA, 1694 bp, Homo sapiens
  misc_feature (84)..(84): n is a, c, g, or t
gcggcacgaggggggtgtctggctggcgtggctccctgtttggggcctctcccctgaatccttcctggggccatggaggccagncagacaccccggccagaatggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagacaagggaggcctgagatctggccctggtgtttggcctcaggaccatcctctgccctcagcttcttcctccacagggcaggaccacagctcacaaggatcccaatgccatcttcctgagcttccaacacctgctccgaggaaaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgcagaaatttgcaactcactgattctctacatgctctttttctgtgataactctgcaaaggcctgggctggcctggcagttgaacagagggagagactaaccttgagtcagaaaacagagaaagggtaatttcctttgcttcaaattcaaggccttccaacgcccccatcccctttactatcattctcagtgggactctgatcccatattcttaacagatctttactcttgagaaatgaataagctttctctcagaaatgctgtccctatacactagacaaaactgagcctgtataaggaataaatgggagcgccgaaaagctccctaaaaagcaagggaaa

SEQ ID NO: 82390 - DNA, 1055 bp, Homo sapiens
tagtttctccagacaggaagaaagcctctcacacttaaacatgcaatgacgtgacacacttggagacatgagtgcagagccactcagccgctcctgggcctctgcagcagatgccagtggactggccttgcagggtgacgaccactaagaggaagacccccaactccatctgagcaggagaaggagctttgaagtaacccgagagctctccaggccccacccagacctttacccgctccccttcttcaagaagatctcctcctctctggtccaggagccctaacccactgcctctgcctgtccccaagggcccgcctccgtgtctccacagcacaactcgggcccaggcctgacaccactggagagaccccaggcccacttctagccaggcctgtgccttcctagtcactctaactcccagagagaataagaatgcatgtaatagctataccaaccgcgcatccggctttcacatgcactgtctcccctccctccacaccccacttcttcacttcaattggcagcgccacatccaggcgtcagcccccattcactccaggaacactttcttatccccacccctttgctcctcttctgcaaagccaatgcaggtggcaggaaggtgaggggtagtggaccaatggcaaccctctgtgggaacaaggggccgaggccacgctgcctgcatctcgtgctggggacctgcatgcgccagcaccagggcttggactggatcttactcagtccatggtgcccagcctctgccccaacatgccctctgcatgtgaccgtcatgccctggatggagccactcctggctcaccccacctgcactgcactgtccccagagagccacccctccacccactcagagacagctgtggagagggccaggagaatgggattaccctatgaccaaggagacatgggaagaagccctccttccttccacgatcgaggttccgccatcaactcggttctcggatatgcaagtacctcactttgttaacttattaacttattggtttcattaaagttttcaagaggaggtgatt

SEQ ID NO: 82391 - DNA, 841 bp, Homo sapiens
acctcggcctcccaaactgctgggattataggcgtgagccatcgcaccccggcctcctatgagcatttcttaatagtgactctcctgatctatccattagggccaatgacccagactacctcacagggttgttgtgaggttcaaatgagataaggatgtgagtgtataataggtgctgtagtttagtttggtattttaatttcagtttacctaaaagcttctgagcttcttggaatttccgataaaaagtttagggaaactgacaatcatttcaaatccaacttattcctttctaacctccccttcttcttcccaacatatatccctgtctagaaagtccctataagttccctcttataatacaaacgtccctggggaaaagacaagagctgacttatctccagataacaccttaatggttcatatatgcttcagttaagagctggaatggcataggagttgggcccttgagagggaagggaggaccccctggaggcttaaactctgtaaagagatacagaaagctgatggcagactaagcagaaggcaaacttggtcgacttcccaatttttctgagggaaaaacctaacagaacagggccatatttcaacaattttgttgtatgtgccaattcctatctaaagggttagaattgtttattttcctctcttgtaagatacacataatttatacatgtaaatgtataaattatttttaggctggacatggtggctcacccctgtaatcccggcactctgggagactgagacagaaggatcccttgagcccaggagtttgagaccagcctgggcaatgtagggagaccccgtttctataaaa

SEQ ID NO: 82392 - DNA, 422 bp, Homo sapiens
ttcgccttcttctccaacattccctctcatcctgctccctctcatcctgctccagctaccactcaccactaatgactttcacatctcctctccagtcctaactgtgctccagaaccctacaagggggctttctggtgtcctcaacaatgccaccaggatctgtgtcattgcttctcatgtgctgtccagtgccattcactatgttagaccacagggacccaaagaaggataagacccattctaatggtcaatgctattagtaaattagcaaatgctgccacaggaaaatacagggctcaggaaacacaaagaaggagtgtctagcccagtctgggtagaagggaatggaggtgtcagaaaagttctccacgagaccctgtctctgagttgacccttccctcaccactggaactatctgtcaa

SEQ ID NO: 82393 - DNA, 371 bp, Homo sapiens
aagtcaccagcacgttaaaaagatcattcaccatgatcagtgggattcatcctagggatgcaaggatggctccacatatgcaaatcaataatccagatacatcacattaacataatgaagaacaaccatacgatcatttcaataggtgctaaaaaaaaaacctgataaaattcaatatcccttcatgataaaaattctcaacaaaatgagtatttaaggaacatacctcaaaataatagaaatagagattttaattttttatgtcataatgaaacatcttgtgcactttccatagagacactgtaggaaagatccattcttatttagacatttttatgtttaaatatttataaagttacaagatataaaaa

SEQ ID NO: 82394 - DNA, 370 bp, Homo sapiens
gaaaaggggaaaaatcacaatatgtgttctagacaatattggtttagattttttaaagatctaaaattcaattatggaaagccagcagcctgatccagttactgtgactaaagcaattgtcagaccatctctagtcaaccccttatgggttttgcaatgtgtctaccccaattttggatcaggaggggtcaaacagaaatacagcaatgtgattaaactgctcctttgcaaacaatatgaaaaggtttgttcttccaaagtagattctaacaaatcgtctgctcactgtggggtagcaaagagagaaaagcaaatctttctattagtctcaagcaagtcttcagatttacacacaatctaatgaagcatc

SEQ ID NO: 82395 - DNA, 453 bp, Homo sapiens
catcagactaatcccagaatatagcttctaatcagatatgcctttgacagtatgcaagactggtaggatagatacagcactaattagttttgttaatgtgatgaatttgcttacctaaataattaattttccatggcttaggaaagtgcatacaagataaaacaggtaaataaggtaaacaaagaaagtgaaaatagaaatgataacatgaatgtaagagaagttattttcaggtcatttgctagagatagaccttttgtttaggcctagctctccagcatatattaaaaggagataagggccgggtgtggcagtgcacccttacagtcctagctactgagaaggctgagttgagagaatcactgaagcctgggagtttgaggctgcagtgagctatgagcatgccactgaactccagcctgggcaacagaacaagaccctggctcttaaaaa

SEQ ID NO: 82396 - DNA, 316 bp, Homo sapiens
aaacacagcattcttatattctgaaagatgggagaggaggcaaagggcaaaacctgatatttcttaggtgtcaacaactacagtttcctatgtttctccatccctatcaggaaaaactgccaggctgaattctcacaaaaattgcctacaatgtcactactgttctccactctttccaagaaccgcggtgaggactggtcacgcagcgtgaggggggcaggtgcagaagagcaagtgtagaagccatctcttcgccggataacgaggcaggaccccagcatctcgtgggacctcctcccttcgggaaattgcgagc

SEQ ID NO: 82397 - DNA, 834 bp, Homo sapiens
gatgactttacatgattgcaggggaaatacaatgcataatgtctagtatgcttattattatttttattatttgagactgggtctcgctctgttactcaggctggagtgcagtggcacaatctcggctcactgccacctcctcctcccgggttcaagcgattctcctccctcagcttcctgagtagctgggattacaggcgcgtatcaccacgcctggctaatttctgtatttttggtagagacggtgtttcactatgttggccaggctggtctcgaactcctgacctcaggtgatccacccgcctcggcctcccaaagtgctcggattacaggtgtgagcccccgcgcccagcccttgttattatttttgacaacactctgcgacttcgttgtccctggcctggcaacccattcaggatatgcccatctctgctggtgaacatgaactctcactgcatggaaactggactgagtccccgctgtcctgagcactttgcaccacagtgcgagtcagcgatcacactctgttcctgacagttgtgtctccgtcgtcaccgtcgtcacaggcgtccgggcccttacaacgagtccagcggtttcttcctgctgcctcagctgatctcccccactggccacattccatctgggcatggtgacagcatgtcccctggggccaatgcgaccacagcctcatgagctgccctcagcgctcctgggggttcctgctgcggcattcttctgtcaccattatccgcatcatttccagtagaggatttccagtgttttccttgctctttccacaatatctcactcaacactgctggccattggagg

SEQ ID NO: 82398 - DNA, 488 bp, Homo sapiens
tcatgttcatttcttcttgccgctgttacaaactaccctacattgagttgcttaatacaccacaaatctactaactaagaggtctgggggggcagatgtcaaataggtctattaaggctaaagtcaagggtgcagcaggactgcatcccttctggaggttctggagagaatatgtcccttgcctttcccagttgctaaagccactcttattctttggctcatggcccctaactgcatcttcaaagccagaagcaaagcatattcgaatctccctctgtgacctgtgcttccatcatcaaatctccttcaattcggactctcttacctccctctttcacttataaagacctcttgtgattgctggacacagaggccgtggctcacagccataatcccaacaatttaggagttcaaagcaggagaaacgcttgaggccaaaacttcaggaccagcctgggaaacacagcgagaccccctcaattaaacaa

SEQ ID NO: 82399 - DNA, 383 bp, Homo sapiens
tagtactgaggctctgatagggagtgtctccttgggtgttgatttcttccctgactgaagtttcccttggaggtctgaatgctttcacagatagttgttttttgagaacccaaggttgtaaacccaaatgcctagagggcgaggccagtaaaatgaatcagtgctttgggccatgtgaaggcctcaggggacctggaggactgtgtcccaccaaaggggctgctgtggtaatgtaggcccagtgtggaccacctgtggagttttcctgaaatctgcattttaactagctggcgtttaatccaaattaaactacggggacactatatgcagctgaacaaaatatttctgtggatcacccaactgcttgtctagaaggactcaga

SEQ ID NO: 82400 - DNA, 417 bp, Homo sapiens
aaattaatcacaaaaatgtaattcatatgctaacttcagcagcacatacactaaaattggaatgatacagagatcagcatggtccttgtgcaaggatggcacacaaatgcatgaagagttccatattttttattcttactaaaatcaattcatttgtaataaagaaattaaaatgcattatttaatttaattcctctatcatatgctttgaagtaatgatcccagaacattcttaagatattttaaaatgtatttttcatataatggtaatttgtttgaaagtataatggagcaagacaagatgatgctcttagtgtgtactaaaagaaaaggtctattataatattgttattaaatcttattttgttattaaatttgttatttgttattaaaatcttattttgtatatattcttat

SEQ ID NO: 82401 - DNA, 348 bp, Homo sapiens
ttagccaggatggtctcgatctcctgacctcatgatccacccgcctcggcctcccaaagtgctgggaattacaggtgtgagccaccgcgcccggccagacctttatggattttagggttgatgaggtggagtcacagcagttttacctggatctaatgagagtggcagaagactccaggtgttagttatttacataattctaacctggtgtttttctccaggcaacctttggaatgagccccaaatgcgtgtaggtagtatatcctatacttactcctgaatttgcttagagcaatattccagaatccttcccaatatagtcaccagatcatggtgctgggttcaggt

SEQ ID NO: 82402 - DNA, 295 bp, Homo sapiens
ccaggctgtgccaaccgtaagaattgccaccgtagtctcaagtgtcatggagaaaaggcttgtaccattaattctgctgttgctaagaaaccttgagcaagaaggacatgctgtctttatttgagcctcagtttctcttgttttacaagtgaggattctaataatctatccaaaaaggtgttctactcttaaattggatttgaaacacacatgatagtaaatatgtttgtattcttaacagtctggttacaaggacagcgatgagaaaacaaataccctgtttaattatttaggt

SEQ ID NO: 82403 - DNA, 334 bp, Homo sapiens
tttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacatata

SEQ ID NO: 82404 - DNA, 242 bp, Homo sapiens
ccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcct

SEQ ID NO: 82405 - DNA, 813 bp, Homo sapiens
ttccagagtcagcggcgcgcgggcaggctgccacgaccctaacccgcccggcggacggggcccagcagggaaagccaatgaatatcccctacccctccacaggctgcccgtagggtttctctgtaaagcgcgacgacgcgttctcaaaagcgccattaatgcgactcgatgcaaagcgtcaaaatgcggtgcgatacacgtatacgtgggaaaccggttcagcattaaagttcaagtggagcggagggggctgcatatttttatttctatttatttgttgagacggaatctcattctgtcgcccaggctggagtgcagtggcgcgatctcgactcgctgcttccctccgcttcccgggttcagacgattcttgtgcctcagcctcccgagtagctgggattacaggcatgcaccactactcctggctaatttttgtatttttagtagtcggtcaggctgctctcgaactcctgacctcaagtgatccgcccgcctcggcctcccaaggtgttgggattacaggcgtgagccaccggcgcccggtggccgggagctgcatttttatgtgtgggcgggagtcttgtttccgcaagaatcgagggaaacggcagtgcaggccagggggggtctgactcccacctctgtccccgattggggtctccaagcgtggttagcggagggagccccggctgcgggtatgacggtggttgtggcagcaagaaggcgagtgtcaccaagggcgtcctgggccccaattcagtggcgcagggtctgcaggactcgaggtgaaatttgagccaagggccccggggc

SEQ ID NO: 82406 - DNA, 418 bp, Homo sapiens
aattttcttattttaagaatttgggaaattgttagccagtatttcttcaagtacattttcagctcttccctctttcttctctctttctgaaactctgatgacacgaatgttagatcttttattatagttccacatgtccctgaggctctattcatgtttttcagtctattttctccgtgttcagatggataatatctattgatttatcctccaattcaatgatttgttcctgtgtctcttccattctgatatttagcccattcactgagcattttatttcagttctatttttcagctctgaagtgcccatttggttcttgttaatatcttctatttctttgctgaagctttctgctttttcatttgttataagcatatgtgtaatttactcatagaataaatgtttgtaccacgcttg

SEQ ID NO: 82407 - DNA, 523 bp, Homo sapiens
tgttattttatatcaggggttggcaaaccacggcctatgggccagatatggtcctcagcctgtgtttataaggttcttgagctaggactagtttttagatttttgaagtgttgttaaaaaatatccacacaaaataatgtgtgacagaaacatacagtatgtgacccacaaaatctaaaatatttactctctggccctttatagaaaaagttttgccagcccttattgtaccctacacttagcttagtacctatggatcacagctgttttatagctcttttgccagtctatagatgtaattttcaacagcttagctaaaggattcacgcttctgctaccttctaatgctagctttaatatatattggctattatgattatcttaagtacaataaatcaaaagctaagaccaaaataagagctgtgcatatatttaaagccctgattatgttcagcattattgctttgagttttgttattcagtaactattaaatataaagctatatatattaacagtaaaaga

SEQ ID NO: 82408 - DNA, 669 bp, Homo sapiens
tcctgaagtacggggccttcgtccctcctgagctcttcggctccgagttcttcatgggacggctgatgaggaggatcccggagccccggatctgctttctggaagccatctggagcaacattttctccctgaacctgctggatgcctggtatgacctcaccagttctggggagtcctggaaacagcacatcaaggacaagaccaggagcttagagaaggagcccctgaccacctcggggacctcctcgcggctggaggcctcgtggctgcagccaggcacggcgctggcccaggcatttaaaggcttcctgacaggcaggcccctccaccagcgcagccccaacttcctccagggcctccagctgcaccaggactactgtagccacaaagacttctccacctgggcagactaccagcttgactccatgcccagccagctgacccccaaggagccccggctctgcctggtggacgccgcctacttcatcaacaccagctctccctccatgttccggccaggccgcaggctggacctcatcctctccttcgactactccctatctgcgcccttcgaggtaccctggtcaccccaggggaacccctctgcccagccaggccaagctccagaggcgagcagcagggccactgagcccctgccccacaccgccg

SEQ ID NO: 82409 - DNA, 315 bp, Homo sapiens
agagaaacaaagtgcatttgtgaaatcaaatccattctgaacacccacaattaatgtgcacttcagcacaaccctcctgagaatgggtactaaaatgacttgaaccaagtcacttctttattctttaaagtgtcctcaaaggttttcaacacctccctacaccaccactccacaaaatacaaaccaaaatcaaagagacttgagccccttttattcatagagggagttatttcccccagccctcatctatagtttttcagttcagcttattagatgctgtttctcatctgtactctgccttctctctgattgaaa

SEQ ID NO: 82410 - DNA, 658 bp, Homo sapiens
acagtatagcaagacagtctgcactggcaaacccaggcctttccatctgtagcccacatagcaaactttgggcagaggcttccctagcaagtttgttcctttcctattcatttctggccctacgaccatcagctcaattgaaactagtccaacagaatcagaggcatttgtaaaaggttttcagaggaaaatctactgtaaactgtgtaatcctgaattagtccatgtttgattctacatgtcttaaataaggcttcagcttatgacatgtctacaaggtgaacaggagcattcgagactgtaagcccggctggatttcagtctgtcacatactgttatttgtaaaggaataaatgttctaaactcagtaagtaaactttagtggtgatacaactaaatcataaaggcatgaccatttcttctgtgaagttatgttcccttttctgtatgaaaatggataaaatcaaaacttagtctagcatattttttcctttgtataaaatgtgaagaatgtgaatccacacaagggaaagcaggactgtattaaaaataacatgtgattacactaaatacatattagtttggaaaagaaaaggaatacatcatgttattaaaatgtcctggtgtgtttctaagtaacagaatctctgtggtcaaa

SEQ ID NO: 82411 - DNA, 417 bp, Homo sapiens
ggaggtaaggtgacattcatccatgttgttgcatatagctttagattattcttattgctgtgtagtatgaatgcatattatgtaaatatatcacagtgtctttccatatgtatagttgtaggtcattcccactgctgtatgctattcctagtgtgaatataacacatgtatttatgtttccttctgttgctgtgcattggatagttcccaggttgtgacaatatggatagtgccactatggacattcaggtatatgtcttttcatgaacatatggacacatttgtgttgctaccaaagaatgaaattgttagatcaaaggacacctatgatcacctcaagtagataatgcagttttccaaaggagttgtacccactgacacagtcaccagcagggtacaagtcccatttgttctgca

SEQ ID NO: 82412 - DNA, 321 bp, Homo sapiens
gtcagagaccaagtggaaaggagtgtactcaatgaactcacttggatgccatagaaacactgagagaaaaggcacctaaaccagcctgggctgtcaggggaggctttctggaagaggtgacacctgatatgagtcccaatggatgataggaatcaatcaggcaaagatggggttggaggaacgcaaagctgcagacggagcagcctattgaaaggctgagtttggagagcatggagcatgtttggttcagtccagctgagcagggaaacgtaatacaaaaacctcaactatgaatcacagggagagagaagcggtagaagg

SEQ ID NO: 82413 - DNA, 937 bp, Homo sapiens
gtctcaaaaaaaaaaaattaaattaaaaaaataaaaaaaatattgaaagagtgattagtaatgaagatggcccccaaaaaagagcagtacccagaggggagagagaattctgaattgagaggactgtttctagagtaccacagccagcagggcacaggccactgaagtgtcttgtatgtctgaccctgtgcagtccctccaagtcctgattctcttgtgatgtattgtgaaggtgctgtgagtgacttggttcaggtgcgaatctgttaggttgttgagcagacagctcttcagcatcccccgtattacctctctgtgctgggcaacaaatcactacaggcctggtggcttcgaacagcagccatttatttcctagcttctgtggggcaggagtccaggcacagcgaactcaacctagggtctcataaaggctgcattcagggtgttggctagggctgggttctcatcaggagacttgactcagaggatccacatccaggctcttctagactggggacagaattccttttcttagggctgaagcattcttggcagctttacttcttcagagccagcagtagagacagagactcttataagataggtgctaaactcttctgtgatacagcccatcatcaccttttgtgaattccgctacttagaagcaagtcagagatctcacctgtgctcaaggtgggaggggattacaggagctgggggcctggggccactgtgaagtctgtctgtcacacttaccaagtgtggccaggagagatgcagaggacaccgtccatgcccttagagatgctgtctgtgggaggactctgcagatgagttggtccagtagaggcatgaagtaagtggggctgtcttttaccacagagcacatggtcatgaggcagagctggaggtgaatttgaatgttgttgtattcaga

SEQ ID NO: 82414 - DNA, 1890 bp, Homo sapiens
  misc_feature (146)..(146): n is a, c, g, or t
  misc_feature (149)..(149): n is a, c, g, or t
  misc_feature (162)..(162): n is a, c, g, or t
  misc_feature (168)..(168): n is a, c, g, or t
  misc_feature (174)..(174): n is a, c, g, or t
  misc_feature (176)..(176): n is a, c, g, or t
  misc_feature (189)..(189): n is a, c, g, or t
  misc_feature (191)..(191): n is a, c, g, or t
  misc_feature (226)..(226): n is a, c, g, or t
  misc_feature (255)..(255): n is a, c, g, or t
  misc_feature (414)..(414): n is a, c, g, or t
  misc_feature (550)..(550): n is a, c, g, or t
  misc_feature (560)..(560): n is a, c, g, or t
  misc_feature (832)..(832): n is a, c, g, or t
  misc_feature (842)..(842): n is a, c, g, or t
  misc_feature (866)..(866): n is a, c, g, or t
  misc_feature (882)..(884): n is a, c, g, or t
  misc_feature (887)..(887): n is a, c, g, or t
  misc_feature (897)..(897): n is a, c, g, or t
  misc_feature (910)..(910): n is a, c, g, or t
  misc_feature (925)..(925): n is a, c, g, or t
  misc_feature (940)..(940): n is a, c, g, or t
  misc_feature (961)..(961): n is a, c, g, or t
  misc_feature (986)..(986): n is a, c, g, or t
  misc_feature (999)..(999): n is a, c, g, or t
  misc_feature (1049)..(1049): n is a, c, g, or t
  misc_feature (1058)..(1061): n is a, c, g, or t
  misc_feature (1068)..(1068): n is a, c, g, or t
  misc_feature (1081)..(1081): n is a, c, g, or t
  misc_feature (1351)..(1351): n is a, c, g, or t
  misc_feature (1754)..(1754): n is a, c, g, or t
  misc_feature (1887)..(1887): n is a, c, g, or t
  misc_feature (1890)..(1890): n is a, c, g, or t
tgttgttgttgttttaggatatgaatttccaggtcctcaacttccacacatacttgttcctaaaattgatttgctttccttaagacttgcctcaatcccctctggcaccgtccactttgtaatgcctatgcctcctcagtccttanatntaggaaggaagtntaaggnacctangnaaagtaaagcccntncgaagattaatcaagatagcataaacctgtgggtntttaaaaacgccctagcgtatacgtattntcatttgttgaagctatcttagaagtttgtatatttactcctcttggtatgctctgaattcatatatgtatggtagagtgaggtggcaagagtaatacattttcattcaaataatttggtgcttccttacccacttttgtcagagtgcttgaatttganggagagttccacgacacaataaagagaacgtctgtatgtgttttgaatatttaaatccccttttccatgaatttaaaataaacactcttttcagctgttgtcagctcattattaatcgcggaaagagaagtacctnaatagtgaancaatatatagattagaggcactgattttaaaaaatgtaattgaaatattttaagatacattggataaaattttgggataaaacttacatgatttctttagtaggagaatattaataagatagttgagacgtttataaatcctgttaaaggaaacccatgccttattaatgtttcttatattcttttaacaaaatataaaatgtcagctgctagacctaattgttttgatagtatacttttatctaattaagtgcatgatttatctctgtagnagatgcattnccaatagatttttactttcttctnttaagaattgtttatnnnaantgtattattntcttttttttacnaattgtatacgaatnaaaattataactctntaaaggacttttttctttgtntctcactttggtcacaggaaatganacaatctaaactncgttacatgtttttgtttgtacatgttgtattatacaagcttcagtgttntcaataatnnnnaaacatnttaagcacagaanacttaaacagattagattttcacacaagaaatagcatacaaaatcaattcaaagatgaagaatctgccttaggaataacttttaatctgttttcccttcccaatttgcagcattagctttccccagtcccataatttgagaacctggtggtagattaatgatggttaccaattctttaccactccccttatcgaaaggcacagactatttctccactttcttcaatctggattgggcctgtttcaccttcatctggtagaatacagtagnaaagacaccatggcagttccagactcaatattttaagaggactggcagcttctctttctctctcttagaagctgactgccaagctatgaaaaagtggaagagccatgtgaaagggcccatgtggaggagaactgggcccctggccaacaaggttcatccctaaacacggtttacataaatttatatttcaagttgtcctcttgacagtttcaaatgagtcaaaattgatcattattattattactacataatgtgggtaaggaaaggcttagacaatattttcatgtccaagcctttcatgttgctttgcatgtttttgaatctttactattgccattttgttatggctttagttaaaactagatcacataatctgtaacatcagagaatcccacatatatanactgtaataagtcacaataggctgaaaagaaacaagtgggaggccagcatacagaactctatgtcatccctcaggatactaccagaaccacagcagtttctttaaacattttgcttcccgccccttaaaaganttn

SEQ ID NO: 82415 - DNA, 560 bp, Homo sapiens
tgcagtgagccaagatcgcaccactgcactccagcctgggcaacagagtgagactgtgtctcaaaaaaaaaaaaaaagattttagtgagaacacaaaccgccagagtcaattatgaaccgtctttcccattagacagaccatcaggccagctctgaatgtcctgtatccagcccaagcctagcatggaggaaaaacgtaggaaatagttgttaatgatgatccaatgcctgctggctagaagacacagtaatgatactgcttgctgtgaccagagtctgaaaagcgattttcaaaccttgcctcaaaggctgcattaaagtgagaaacttatccatgctggctcttaccaacctactgcttcccacagtagcctgggtatgaaatggccttggaccattctgaacagtaaattattattctttgcattttaataactttagggaaatataacattttgacacagttaatgctcactctattgttccctgccccactaagtatgtgactcaggaaggcaagtaccagaagtcccaggtaggaactcgtccataaaaaaaaa

SEQ ID NO: 82416 - DNA, 308 bp, Homo sapiens
aaaaagaaaagaaaaagaaagccaggcttcatggaaagatcgtatgtgtgacccaaatatgagttcttcagctcagccatggtaatcccttctctctccactcccgggagtgagagagacggtagatttggaatcatgcattttagcaagtggacttgttgaaacaggaagcaagggccttcagtgtagcccattcttgatccagagctgttgcctgtgacacgcggtttctctggatgtcacaggcagctgcctggtgcccagcttgcttctcgactggtggcccctatgggtggttgtgcgatgga

SEQ ID NO: 82417 - DNA, 644 bp, Homo sapiens
tcaagagcttgccggtgagcctggacggaggcataggtgcagctaattaggataagacaggggccgcgctgtggtcagccgtgggaagccggcgaggggactggagttggggctacacttgcctccctcctatgctgcttcctgagccacgaagtggtcattgccagcatcccaggcaacaaacagcaagactcagacatctccaaggaaaccctttgagtggatctgtaccgttgttctcgtcttgctctcttgctgccctgccaccttcacagctgctttctgtttcctggttccaggaagacagcggggcacagggtccctgctttgtgaggagcagctggcttctccctttgcccccaggttttgccctcccacatgtctcccttctggtgacccggaccccagacaaactatgcctgcctccctgaagccaggcatcctgaggaacttgatagacaaacaatgacagtgttttccagaactgtgggtacgtgtctaatctcagatggtactatgaattcctggagatcaaagtttggatctaattcaacccctgatcctcgaaacggctttcttgcaaagtgtatatattggtttctttgctgaatgaatgaataaaacatggaaaatgtggtaattca

SEQ ID NO: 82418 - DNA, 583 bp, Homo sapiens
tcgtctggtctggtggaactaagggagaggtagaaaaccagctggaacctgtttaacaggggacagcatccagatgcccacagaaaagctattttcttcaggaggaccgtctttccacttccagcttcaccctccacacacatgacagagttcaagttgccaaagacctcaggcagcaccagaggttcttgcacaggtttgctgatgtgttttgaagcaatagacagatcacagcccagcaagtggtccgtggccagatcggaagagatatcaagcaaagacatgtggcggaaactggcgctggtataagctgctctcagctgctcattcagattctttgcctcttgaaaccactgggcttcaccctgtgccatttctgtggagagaaagaaaggggggcacaacagggattcatagtcacatctccctcagtctgaacgccatgccttttcattccatgattctgcctgtctactatgaatgtgttaggattttccacagccatccatgattcccacattgcgatcatctcataggttttggcacaaaatcggaatgtgggaagcatgtgtccaaagtgcca

SEQ ID NO: 82419 - DNA, 340 bp, Homo sapiens
aattaatcaatcagccattttggtggccgaaatttataaggcaagtaatacttttagtttctttgatagacaccatgatcagaaacatagtctctttcttaaagggaaaataggaagtcttctgagtcataacagatgcatacataaatttctctgagtcttcataagaaacacaagcaagatttcacagaggcagtggaatttgaactgagtcttgagaaataagcaatatctgaacatgtagaatgcaaaataaaggataagcaagtgctaatgcccagagggtaatacatattaaataaccaataaccaattgctacttgtgtttcttacactagaa

SEQ ID NO: 82420 - DNA, 502 bp, Homo sapiens
attgaatgagttcgaaaaatgcttctagttttcacagctttttggaggtgggtattgcaatgaggaagttgaacctggaccacctgcccactgcctatgggcaaacggaggctaggagagttcaagtgactcgccccagtcctgcagcttatagatggcggagttggcattatggccagggtctgctttacccccaagtcttgtcccagctctgccactcagccacattgaccctggaagtctcccgtaaatagtagcatcttgcacagtgacctggcatgacactgaagccataatgggcaagtcactgccttctctgctttcctgaaaaaggtgggccatatcacatttcctgaatcctaagacgtgtgtttctgaagtcagatgtctcagaatgcatgtgtccatttaccaagagagacttgtatttctatgccctacttccccacccccaggaagctcttattaaaatgctggcatcttatttcatggcacagtagag

SEQ ID NO: 82421 - DNA, 623 bp, Homo sapiens
atgcaggcagggaaccagcctcggcgatggaaatcaatgaataagacttaaccttcctggtggcaaatactccaacagggacatcacagaccttccacaactctgaggaagatgaaagtctcccgtgcacccagctctggctgaggacggaatgacctggggagaacttgggcacttcaggttttgtgcccagactcctcctgttgtccctgcccacctctcctaccccttcctcctctggaagcagtctttctcttgctcaaaaaagccccaatcctatctctgattctagctgcccacaaagccccagggagaaaaccttcccaaaaaggcagtggataaatcagaatgcagtgaggagcggatcctttccaggaccaagacagatgctgaagaagacagcagggaccggagcccagcaaactggatgagagcagcaaggccttcatgcatcttcaggctccatcagcagagggagagaatgcattagacgggagtttcctgactcctattttctaatgtggcagtcctaatgagaagagggtttgaagcgctaagatgtgctgacagtcctaatggtttgttatgagtttccttagaaaaattaaacactgaaaaacaaa

SEQ ID NO: 82422 - DNA, 207 bp, Homo sapiens
cctcctgggctcaagtgatcctcctgtctcagtcacttgagtagctgggactacaggcgtgtgccaccatgtccagctaattttttttcttttctcaacttttagttaaaaaacaaacaaataagactgtgtgtctatagaattgtctactttttatttggataacttaaaaaatttttttttgaatagtttttttttttcttggcc

SEQ ID NO: 82423 - DNA, 350 bp, Homo sapiens
actcgggaggccgaggtaggagaatctcttgaacctgggaggcagagtttgcagtgagccaggattgcaccactacataaaaataagtaaatgtacaaagtcaagctgtggtgagtgctgttaggaaataaagtaagaagataggagtgctcatgtttggaggtcacgacaggcctccctgaagaggtggcacttcaggagagactgggacagtcaggaggtgagtggggcatcatctgggggcctcaggataggagtgaatttgagatggggcttgaggatgtagacagagacagacgagagagagaaacagtgagatagaaggagacaccgagagacagagatagagg

SEQ ID NO: 82424 - DNA, 472 bp, Homo sapiens
actctttaacttaatatacctgcatgatgaatgtatttcagaaatttgaatgaaaagtagtattcttcccatatattaaagttagttcacttaaaacctatataaacattttaggttaaaactttaatgttaatcatttgaaataataatatacttgttttaagtctatctcttagatattgtagttattttaaacttgatcactttctgctaatgcatactgttagtttagtcccatcacatggttaactgactatgtagacttcttaatttaaaaagaaatggcaaaacagacaaaatgctgctaaagaaatttgcaaaggtctcagacaggggaagaatagaaaagaaaaagaatagcagtattcattctctaccttactactcccccccaccttccattttcaaattccaagtatttagttgaatacttgctgaacttttttcagtatttttattggacttgttaaaa

SEQ ID NO: 82425 - DNA, 280 bp, Homo sapiens
tcccccattggctctgttcttcctgccagtgctcttccccctgctcactgggttccagctgtgcgggcctccctgctgttcaatggaatgagacccatgcccctcctggttatcccactcagagtgcccttcaacagctacagggctggcccatcctttctctgttaccttcggaggaagccttctctagataccatctttaaaacagcaatcttccttctccatccccagcagcacctctgacccccttcacctgctttatttttctccatattatcat

SEQ ID NO: 82426 - DNA, 128 bp, Homo sapiens
atgctgaagaacctattttcttcttcccagttttatcttggtcctatccttggtccaaacttctctttccttgaacacaaaaggaagacgcagatggaagccctctgctccctggatcctcaattgac

SEQ ID NO: 82427 - DNA, 650 bp, Homo sapiens
tggcgggtgcttgtagtcccagctactcgggaggctgaggcaggagaatggcgtgaacccgggaggcggagcttgcagtgagccgagaccgcaccactgcactccagcctgggtgacagagcgagactctgtctcagaataaataaataaataaataaataaacgaaataatgaatttatatggcactaggcctcaactaggatttattttaatagatttagttacccagttcattctttttctacccattaagaaaacatatattgacagcatttagtatgcataaaatattcctgtcctaaagaactacttaaaaatcctaaagaactacttacaaatttcccttctaggtagtttcctttgcacaactaatatgcataatagcaccattgaaatactgtgcttttattttctcaatgtccatgatttttggatgacgtaattaagtgaattaaacatattttgtacttcttagtttctttctataagaaaataaaatggctgggagcagtggctcatgactgtaatcccaacactttgggaggctgagatgggaggattgcttaaggccaggagttcaagaccagcctggttaacatagcgagaccccatctctattaaaaaataataagtaaaagaaaaaatgtat

SEQ ID NO: 82428 - DNA, 414 bp, Homo sapiens
ctactgttttgtgactgactggccaatcaccaggcatggatctccctcgtcattttaggacggagtcactttctttgtgccatcctgtacagatggacatttcagttgaaaacccatactgggaggaacaggctgacattggtagcgttgccagtgtgccaagtactatagttcttggggagaaaggaagcggaatcgctggcccaggagttttgcacacacgtgtttcaggcttttggaccatgactccaggctggcccacagaaggccctcgtcagaagagcagtcacaggccggatgcggtggctcacacctagaatcccagccactttgggaggccaaggcaggaagatcacttgagctcaggagtttgaaaccagcctgggcaatatagtgagccctcacctctacaaa

SEQ ID NO: 82429 - DNA, 587 bp, Homo sapiens
tattgtattcattctcatgtgggctgaataaatctgttcacagcaggtgcctctatctgaccttaccctggtccccacaggcttcttccagaagagcacaaagggttgggtggcataagagctcatagaatattcatccagatgccttcaagggaaataggaaaatatacagtgaataatactgatgttatttatgtgcttcaagatcagtccccctcgacaggcattagtattctagttccttcagccccaggcatttcttggtaagaaatattcagtgatccctaagaacacgtgaggtcctccccacagctttatggagatacagtcaaggcacggtagaaggcagctgcaaagctcatggtgccagagaaatgggagaggccttcccacaacctcaggctctgagaagagcaggcagctaggacagggcaggcagacctggaaacaccaaaggaagaggcagccatggtgtagatccacctgagggccgttcctgagagcggacagcccggccccgccccaggagtgtcccgttgtatttgtacgcacagggacgaaaccattttaggatttgtctcaaggct

SEQ ID NO: 82430 - DNA, 738 bp, Homo sapiens
agcggcggggattacgggcatgagccactgtgcgcaatctgattttagatttcaaacagtataggataaaattgagagaaccatttggcaataaaaaatattaaaactgagtttgcagagaagggcatgatctatatatctactattaaaaaccattcaactgaatatatttccatggccatcacaccattattaaaacctctgaaaagactaacatgtaccagagtaaagatccacataagacatgtgtattagggttctccacagagacagaaacaataggatatatgtatatataaaccagagtttattaagaattggctcacacaattagaaggtgaagtcccatgatgactgtctgcaagctggaggagagaagccagttgtgtgtctcagtccaagtccaaaaccattaaaaccagggaagctgacaacgcagccctgagtctgaggccaaaggcttaagacccactgagtggccaccagtgcaagtcccagagtccaaaggctgaagagcctggagtctgatgtccaagggcagcaggaaaggaagcgagcatctggcatgggaagaagaaagattcagaagactaagcaagcaaacgaatcccaccttcctttgcctactttgttctagtcatgctggcagtcaaactggatggtaccactcacactgagggtgggtctatttctcccagtctactgactcaaatgtcaatctcctctggcaacaccctc

SEQ ID NO: 82431 - DNA, 549 bp, Homo sapiens
gggttacccaatccagtggtgttggaacaactagctggttagcatctcacttggtgaacactgactgctctgtccaggctgcaggcaagtgtgtgtgggcagcatgaggctttacaaagtgtgaatgagttgcaaatgatttcaaattaggagattcacataacaagctgtggaaggaaacaggcagaaggatatacaagaggtcatccccaatagcagtgtgaatccacagccaccagacatcccgatgggcgctgagtctcacaaatgatcagatccatgcccattccacatgggacaccacttccccctctcagcagaaacgggaaagactgggcaggtgtggagaagcagcctggagatgcctgtatgggcagaaatgatctaggttttgcatgctctctggcccagcgagcctcttcccgtacatctcacagaaacactaggatacgtgaaaataagcaagctggaaaacaacctgtaaagcggactctgtttttgtttttaaaatatttgtgtagagattgaaaaacacctggggagacatgt

SEQ ID NO: 82432 - DNA, 815 bp, Homo sapiens
gacaaagtcatgccagtccttccatactggcagttttaatttttacgaaaccacattcttcacgatgcctgatgctgtgcagaagagcgtagtctagaagaaagaacacggattttggagacaggcattcctctcaaccccaaacctgccatctcctagccatgtaactttggacaaggggcaatagaaagacaactaaagaaggatccaacgatttgaaattccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatacacactatttcaaggttgcaatggacactccccttccgttagacaccaggacctctatctccattggacagccgacctggaacacacagacgaggttggaaagagtggacaaacccatttccaaggacgtcagaagccaaaacattaacaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgagccataaaatagggatgg

SEQ ID NO: 82433 - DNA, 692 bp, Homo sapiens
ctggcacccactcttgttgcttgctgaagattagtgacagacaggatgtcgcagacacatctatactgattagaatgaccctcctctctttttgctttctgtcttacggagcgaaaacatctttaaaaactacagctgaaatgacactgtgctacaccggtgaggggtttcttttctgtagtcaagtctaaaatattacctaatctgaactctccaaaaataactcacaacctaaaatttttcactccataatcctttcttttttatgttattatttttaatgtatcaatgatactgcatcagaacaggtggcttttggccaaaagtaaaaacattttgttctgaccaatgtgtgttttactcatatccaaacacaaccagtaatatgaactctgccccatgatgcaggagaaataaatattaagaatgtcactattctggaaaattattttgcctgagcatttaaaattttttatgtagtttttagcttccataaggaatggtttatgagtatgctatgctatccagataaggggaaaagctacttggtgggggcaggtgggtgtgagtgagagtgaagtatataatcaagtggtaagtattagaaatacctagtcagtgcttttttttaggggaggatgagaatatatatattaaggctctcaaagaagtaatacatttacttcagcaaa

SEQ ID NO: 82434 - DNA, 833 bp, Homo sapiens
gggcctagagagcgggcgtccagcagctcttggcaggacgcagcgatgtcagccatctgcagcaatgaggcggcgctgagcacctcgtggacgttggccgcgttgaccagcagcttggacgtatagatgaagttgaggatctgctgcaggccaccaggtgccagtgcctccagggacagctccacacgctgcagctgcttgttctgggtgaagagtgagtggaagaactggctgtaggcggctagcacacccttgtgtgccggaaagacgctgcgctggggcaccagcaccaagtccacgtcgcagaggtcaggctggaagaggcgctgctcgttcaggcggcccatcaagcaggcaaagtgcagcgccacgtcctccaccagcgagaactcagccgccggggagtcagttgtcttctcaaccagcaactgcggggacagagggcacaggagtgggtcaaggccagtgggcccctgcccgcccttcccccagcaccactcccagcattgccagccatccaggaggcagcccatcactcgtggctccactttacagcaacagagccgaaactagcaaggaagggattcaagcctgagtgagctgcctcagagctcaggctccactcgtgaccctctgaggctgaagatcaggtcctgtcactttctgggcctctgggtcatctcctgggaaatgggaaaagtcatcccaggaagggaaagggaaggaaaggggatgaaagagagaccacagtgaccaaccatccaggtttgccagggacctgggcattttctggggtgcagggctttcagtgctagaaccaggaccatcgcagg

SEQ ID NO: 82435 - DNA, 695 bp, Homo sapiens
gagccaaacaggatggttttatacgtgtgtgtttggcattaactttatttcctattcacgtaccagatattactgcccgctcttatgaaatagtttattccaccataaatgtatgttttaatgatcaccacatttttttggaatacattaatctgtctaaaaataggtgattaaatcatctgtcattctgctgtgaagctctttaatgttttctttgggaaataaattagaatgccatattggtttccaagcagacataagctggcgatgacttttttgtacaaaagttactgatgaaaagctcatagaggcatttggatttcttcagggttgtaaatccaggtatgttactactttatctactggaaattggggtaatgcaggagatgggaaagcatgatgttaaatcaactggtgaccccaaataattttccatggtgttcatcagccatgcacacactgtattactgtcatcattcctagcttttccactatgctgtctcaagtttgcacaaattgtaagtgattttaaatcattaactgatgtgacataatcaaattacttagggttttatttactgtgctccgagtaattcagttatgacttggcaaggtatttaacagacaatagtgaagttactacaaattcaactttgcattggacaactccatttgaggataccaccaccttcaaa

SEQ ID NO: 82436 - DNA, 459 bp, Homo sapiens
gttcatctagcagggaccccaaggagcccagccacacagagggagcaccagcagcttataggacctggcacttttccctctggtgttggccaggcttggttagtcatggctaattaggcctccaaaccatggccaaaatcactccctgaagtattgtcttttagaaagcatcctcattcattccttcgtttgacagatatttattaagtgtctacctgtgtgccatccactgttctaggtactggggccttgtcagtgaagaacagcaaaagatccccacttacttagaggcaataactaatagataactaagatgttagaaagtgtgataaaggctgggcatggtagctcacacctgtgatcccaagcactttgggaggctgaggcgggtggatcacttgaggtcaggagttcgaggccagcttggccaacatggtgaaaccctgtctctactaaaaa

SEQ ID NO: 82437 - DNA, 775 bp, Homo sapiens
aggattactattaatggagaaagcccaaaacatcggtcatggcatactttaacacctatagctgatgataaacttttcctatgtggtggactaagtgcagataatatcccattaagtgatggttggattcataatgtcacaacaaattgttggaaacaacttacacatttacctaaaacaagacctaggttatggcacacagcctgtttgggaaaagaaaatgaaataatggtatttggtgggagcaaagatgacttacttgccttggatacaggtcactgtaatgatttattgatctttcaaacacagccttattcactactcaggtcatgccttgactgcattggtaaaaattctatcatgttagaaagtcagatatctttattacctcctaaacttctgcaacaagtactcaaaaaaataacattttgggctgcagctaatcaccgagaagaacaaagagtccaaaaagaagaaacagaaaataaatatcagtggatcagtagcaattaaattgttatatactttacatatttagtatgttttaactttttaatcagactatacatttacactcccaaattgcaggctttatttaaaggataaaatttaaaggataaaaaaacagtcactctgttaagtgactatatgccatgggatatatggaaaaaagatattaatgcagattaatttatatttgtaaacaaatttccttacaaactgcagaacaaatattctttctgaaagtaagtacagttataacagattttaaatc

SEQ ID NO: 82438 - DNA, 407 bp, Homo sapiens
  misc_feature (401)..(406): n is a, c, g, or t
gtaattctcctgttaactagcaagtcaaggaatccgtaagcccatcttacatgtctttgggtggtgaggaaaatctcgatgatgtccatcaccgacagagtaagagactaatactgttaattgaattcccctaaagagaacaaaactataccatcgtgtggggggaagggtagaagaagcaaatccatacaagtctccaatatgtttgaattggttgcattgattttcctcagctaatggcctaggatagatgctgaattgtcctcagaaaatataaagttgattagagcagcttatttccacttaagactttttaaattgcagctacaaatatttcaaaggtatatgtgtatatttagatatatatttttttaataaaacattttatttttctattaaannnnnna

SEQ ID NO: 82439 - DNA, 599 bp, Homo sapiens
gggacagagccaatgtctttttcaactttatccccagtgtgcccctgggcttggtacacaacaggcaaccagaggcatttgttgagatgaattggaagagagtgtgacgcaaatccaacggaatgacctttgcttgtggctgggtttggggcgtgtgtatttttttaaggcaggatgccggctatagaacattttgtgagacatcctgagccctgacagcaccagtgaaattctgacgtagttagtcctgggtgataaaccggtgtttcatttcctgctttggaattctttccagtcacaagaccctcggtgtctccaggcccatggccaaagtttggagaattacactcatactcgcccacgtggacagcgacattcatttgccaaatggaaggtatttaggtttggagtgttttcttcttccttctccctcttcttaagctttcaccagggaggtctttggagggtgccattctgtagtgacaagcatcagtcataggttgaccctgaacctcagcatcagcatctgcaccaataatctggagatcaaactaggctgaaggccaaggagttaggaggcacacaggctcccaaaatgt

SEQ ID NO: 82440 - DNA, 719 bp, Homo sapiens
ggggaggtgagtgtggtagggaggttctcagattgaggacatgacaggagattcgagggctaaatacatttctggattttatctctgtggaaatatgtttatatataggagatcacattataagcatgatccctttttaaaatatgttgagtggtgtcattcctaaatccacctgaggatgcttattattaaaagcccaggcccccttgttgctctcagcttggtgcttctggcagccagctaggtgctagtctgttttgttcttctccaggacagccactaccttctctatccccaagggtactattctgctcttaaattgctgttcccaaatacaaacctgcaaatctattccatgtacgggttttactgttttattaccgtggaggaatgggataacaaaaagctgttaagatgttggacttcacctttaatgctcattggcattatccggggagcttgaaaaatactgatgccaggtgccactctagacaaatcaagtcacaaactcagtgaatggggctaaaaccctttactatttctgacaatagttcctcccttaattaggatactcctgctttcaagcgttgtagcctaaaactgcaatcaaggcccaaacacaaaaacgtactgagtttgtcctctgtgcctggcactaggaagagcaatagtggaaccccctaagtggttggtttgcatttttttacgttcctagacta

SEQ ID NO: 82441 - DNA, 494 bp, Homo sapiens
tgagacagggtcttgctctgtcacccaggctggagtgcagtggtgccatctaggctcactgcagcctctgcctcctggctgaagtgatcctcccacctcagcctccctagtagctgagactacaggtgtggactacaatgcctggccaattttttgtattttttttaatagagaccaggttttgccatgttgcccaggctggtctcaaactccttagctcaagcgaatccactcacctcagcctcccaaagtgttaggattatagccatgagccactgtgcctggcctaccttcactttttccaagttgtctcttctgctgctatacctgtggaacacacagacccttcattggggagggtaattatttttagttgcagaggaagccagaaacctttgatggctcaaagaagtgtctcatcatcataacacatagtaagcctcagtaaatacttgatgaatacttgagcaacctggcttcatttttaaattatt

SEQ ID NO: 82442 - DNA, 521 bp, Homo sapiens
actaaaggaatttgggtgtcttaaaagtttattctaatgagactgtgacctgtatgccttaatgtatttattgcccaacccaaaacaacaacataaaaaggtgctataatgtaaaaaagttagcattttctatttacagacaattttcaaagtaggaatctaggtcagtttcaccttttctctatactgtattcctgcctccaatgaccaaacctgaaaaaatatgtttcttctaagaaaaaaattctcataactcctttttagtttttataactgcagtattttcttcatctataaaattttactgagtgtgtgcttcttacctttacattaccaaattcttgtttattcttcttccacattggtatcccacttacttcttctttcaaagcctcatttctctgtgttccttagcatttatataaccaaatttcagtctgattatcaggaacaaaccattcaaggattcctagaactcaatactgctaacacttttttttttcaatgacatgcattgcttg

SEQ ID NO: 82443 - DNA, 114 bp, Homo sapiens
tggggtaatttgttacatggcaatagaaaattcgtgtctttacctctgccactactactgcatatatatatttatgtatgtatatgtatgtgtgtgtatgtttatatatatata

SEQ ID NO: 82444 - DNA, 738 bp, Homo sapiens
atattcaaatactcccagccgagaagctgccatcgatcctcccatggacccctgatcctggtttggaggaacttttcacagctctctctccctccctcaaaccctgtgcaatgagtttgcagaagagagtcttcccgagaaggcagaacgggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaatctagaagcacaaagtagtaacttcctgtttcctaaagcctgccaccaaagggcacgcagcaactcaaccagtgttaatccctattgcacaatgagacaattgattttccaatgacccaagaaatctgcagcgccc

SEQ ID NO: 82445 - DNA, 564 bp, Homo sapiens
ttagcgtaagcaataatcaacccctttagtgagactgtaagctccatgagggcaaggcctttgttcatttctatgtctctggtgcctagaagaatgcctacccatagtaggtgctctgtgaacatttattgaaaaaaaaagtgaatggactgagtgtctgctatgtttgggcctgtgggaggtgctttctataaaagtctttctaatcctcgcagcaatccaccgtgcaccataagggtgtctgtcgtccattctagggctccatctggtgtgtgtttaccattatcataagcattattgtgagtgcttccagagcagataatccttattatgactgaataatgtagctacattatccccattttacaaatgaggaaatgaggcacagagaggtgaagtaactcacccaaggtcacacagaccctcaagcttcaagctactccttcaccttcatatcagcactgtcttacagaaccttctgcaggatggaactgctctccatctgcaccatccgatgttgtcaccgctagacatgggtagttactgagtacttgaaaggtagct

SEQ ID NO: 82446 - DNA, 241 bp, Homo sapiens
gcaaaatgaattgtcacatttataaatatacaaagtccaagaggataaaaacaatgatctacgggctgtagaacaatacacacgcggtggcagagtgtgagcaacacactgacctgtcaggtaatacaatctaaatccaccaactctgtaggtgcttacaattttaaatacacatatttgacagggacagacagacacacacagacacaatgtaaacatttgggtatggcaggagattgca

SEQ ID NO: 82447 - DNA, 439 bp, Homo sapiens
taatggttttttcacacaatccccgacacacacttgcactttttttccgcttcaaaatgacagtggatgtttgcaaaagcccctggagtctagaaggacatcaatcactttcacagctggagtcgtaacactttccttagaggaaattttatgcagcaagcagaataagcttcatcctcagcaggacaagacaaaaggtaggtaaaaggaaaggctggcagccaccaccaggcttttgtgccactaactgggggtggggtggggtacatcaattggaacttattcttcaccccaaggcttgcctgtttgccttccatttcccttctgaatttgaggaggagtaagtacagcaccatgaaaccagctcataacaaaacaagcacttacctccattgctactcaaaacaaggacaccacaggagagttctccagggatctt

SEQ ID NO: 82448 - DNA, 384 bp, Homo sapiens
taagagggacctttgtaaagcatgggtctctgtgtcccgattccatcatgggacaactaatcctaaatgataaatgtattactcaggcagcccctgatatcagagggaagttgcagaaatgggccctggcgtcggggagtactttaggagacctcctgaaagaggccaccttggtcttttacagtacagatagggagacacaagaaagaggcagaagctttaagggtcaccatgcaaacccacaaaccccagaattcctaaggtgcatctgttaactcctacagatgtggcaagaacagttatctctcttctaaaatttaaccacacccatgcaagtcttaatttctttcactaaggtgaaacagctcagggtacaatgttgtt

SEQ ID NO: 82449 - DNA, 396 bp, Homo sapiens
tcccagacaaccaggagactcatgacccttcagggatcacagtcttgggctaccatttgttgattgtcagaaaacagttggcgcaaatattttcttcagttttgtggttgtttaaagtggaaatagcagtactagttattttcttgtacagaagcaggatatgtgaggattactgtttaatagccgttaggcatacaggttctttgcaggtgcttggaggaatgtaaggattaatacagtcagtttcctattgagcatggctggggtgggattgtgtagtggaatgtatggatttagaatggttcagtataagcaagtatccagcgtcatgattccagaatacagttttgctcttacggcatgtacattctcagaaagtacagaatctaaggatga

SEQ ID NO: 82450 - DNA, 425 bp, Homo sapiens
tacaggtgttagccacagcacctgtcctgatccatcttgttattctttaacacagtaccctattcattttgttgcactgaggacaatttgaaattatgtgtgtcatacttgtttatttaccatctaccccactagaatataaattaaatgagggcagagtcatatctactttgttcactgtttacctagcttgggatctagcatctagcaggtgctcaacaaatatttgatgaattaatgaaaaaagggaaatgtcttcagagtccatttagactttctccggcttcccatctcagtggctactcattgagtgggtcctgccttcaattaacttccttcttctcttcctttctacactaacctcactgaggggaggagcctcagggaagttacaagggtaagtttctaatgtcaaatgcaggaga

SEQ ID NO: 82451 - DNA, 895 bp, Homo sapiens
acaagcattaggggaggaagaaagccgaatgatcctggagcatgtccttggcgcaggcactgctggacaaagcagtccatctcggtgggctggcactgcggagccagcgtggacattccaccgagcacgaggcgaaaggggcagcccagaggcctgccactgaaaccgccttctgcaggcaccgtctgccagtgctcagcgctgttagcagggctcctcctctgctgggatgaggggttgggatgacaggggttcacagtgtcctgcctgccccttcagcagcataacctttgtctttctggactcctggctggagctggtgatactgtgaacatgctgcctctctggaagctgctccatgtctccctatatccccagagcatggcagctgtgatcagaattccacagggtggggctgatgaggatccatgcacatccgtccctgtacccctcattagggacttgggttggggggtgcctatctgcacgtgttctttttcctctcacgcactttgtcggtctctgtgcagggtttctattatactaataaggagcactggggacgctggcgacagtgtgataatcgtccccttggagggccagaggcagtcggtgtgcgctgacctcatcctgggggagtgctgatgaaactctggcttggccttactgcctgagcactgcgcctgatgtggagggttagggggcagggttgccgggctgtttcttctacggcttcattgttaccagccatgcttgtctttggggcatttcatcaaaacttctttagttttgcttaagaactttaaagagctgatgagcctaatggaaacttttcagtaataactcagtacaggaacacacttcacaaataccagctaattaatcctcagagcac

SEQ ID NO: 82452 - DNA, 332 bp, Homo sapiens
cctcattttttctcttctctgttcccttttacaatgaattccttaaaaagaaaacatgtctatattccctatttccctgttttctcttttctcttgaaatccctccagttagagtttgccttccctccccaactccacttcaccaaaacttgctctgatcgactcccctgttgctaaatcgaatggtcagttctcatctaacttgatccatcagcagcatttgacagagttgatcatgctctccccaggaaattttacttggttttgagagctccaccctcagtctttctactgcctcattggatgctctttgctgttctcctttcctggtt

SEQ ID NO: 82453 - DNA, 620 bp, Homo sapiens
cttcccagtcctctcagagtatgtctgtgactgaatgagtcagcggtggaatccttggggaggatgtttcaaatccaaaatttgggtcttttgggaaagcctcagttggttctgagccagtggctctctgtttctggcccctggcatggacgtgatgaaggaatgctaggtgggaacagagtggagagggttttaatcagcctgggcagtggtgtgggctctgggtggtggacattcttgtgttctggcccaggctgtggaagctccaggccagcttgtgggggtccccaggtttccagagttgactcagagaaggagggctggtcggcagctcagaggctcttctgcagaaggtaaatctttccatctcatatttgccttgccgctgctctgttccccactggcgggcactgccttccctgcacagggatacacatatccaaggaggagaagacagaagccaggggtcctgatgattggggcaggtgatggggtgggcgagagagagcctgtgtgtttagtacccctcccatccagaaaaataaaaacatgcatttatgttaaaaatgacttttgcttaaaaagtagcatgttcattgtagaaatctggaaagggaaat

SEQ ID NO: 82454 - DNA, 644 bp, Homo sapiens
tctctcactggtgcccactctcccctgaatcacactgcacagggtctctcctgtctgaagagaagaaaacaccctgaaaattaagaagataaaagtgatggcggtgctgttcaaaaggagagaatgtggaacccttgggctttgttcctaatgctcggggacgatgagattgagagaactcatggagtcaacaggtgtcacagatgtcccaggaaaataccaaaaataaaacaaaaacacctctcgccttgccaaacgagaaagcaacatcactcaactgcagggcattttggcaactaagagtgtttacccccagagaaacagctgcccttgccccagcgggcaaaacaggcctcccttctacccctccccgactcccttctccctctggaggtttcttttcggcatccagccagacagaaagaaggcaggtgacagagcaggggcttaacaggtcccacgcaaggctcagctggggaaggccactccaaatcactttggcaaacttgaactgaaccgcaggccaccgcagccgggaaaacaaacaagagcctgtcggccaggtcctgctagctgtgcccaagctgcagctcccctctccctggcttggagtggagcaataaaaggggtttgtgaatgcatgt

SEQ ID NO: 82455 - DNA, 707 bp, Homo sapiens
atagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaat

SEQ ID NO: 82456 - DNA, 450 bp, Homo sapiens
caaatctggaaagacagtctcccgtgtccccaccttactaatcccgcacacttaccctgactttactcctggggctgtgggagacaggggtggaatgggcccctgacacgcaggcagcccctcctatccctgcatgaatcctggcatgaccccggacacccaagaaagtgcacctttgacaatggtgcaccaggtcatggtggcacctctccccttggtggtggcatctggggcccttgcacacaggggacaaggaacctgaagtgaaggggagttgacctattgaggccacactgaggacagtccctctcactttgggagaggagatggcactcctggtctgatgttccagaattcctctccatggaaggagaggagaacaccataacatattagagcagagaggggatccgcggcaaaggcaaggcttctgttacaaagatggggaaa

SEQ ID NO: 82457 - DNA, 441 bp, Homo sapiens
gataaaactataaaatatacttgaaaaatcacaaagttttaaacacttttataagtgtactttttgctttattgaatgcctggagcagtttcagaaacttacatagtttgggagttctcaaagaaacagccatcaatgacgaatatagccttttgatgttccagagtaccgcactctgacagttgtctttcttacactgtcttcttccaccactatggtgtccctataattatgcttcaaatgtgctgtcatttttgaatgctacattttcacacatgagtggatagacatgaacagtgttttggttctttcctttgtttcccctattgaactactttttttagtaagtccatgttaattaaaattctaatgttctcatcaaaattgcatttttggaataaatttgtatcaggatcaaatgacattaaatcattcaaaatc

SEQ ID NO: 82458 - DNA, 287 bp, Homo sapiens
aacagatggatttcctgaaatcaccactgtctccatggaaacagctcagctggctctatcagttgctataaagtgttctctccttggtgtggatggaatcttcgtgttagtggaggaagaggacccaggacagaacatattggactaagcttagaagggagaagacaagatttgggttagctattagaggcttagaaagattctcccaagtgttgaggagatgtcagacgttgcctgctctaatgatttgtatgagaatagtggcagcagttcctgaagttggaagg

SEQ ID NO: 82459 - DNA, 406 bp, Homo sapiens
aaccaggaatggtgactcatcccagagaatggtaacagcaggaagctgctggctggaggcagtgttactgaaacccaggagctgaggtcatgtggcaaaagctggaaccacagagaggactgtctagataagctttagtcacaaatgagatggagctgctgctggagacactatgggaaacaaagagaagagagaagaaagaatgtgacttctcccttgctcctaccttccatccttttactaatagccttcattggtcaaaactactggaagcccagagaccaggggaaacagaaaaatgtagttccccgctatatagaatagaaccagggagaggcagggattggatctaagaccaactaatctaagcaaatgattggcatagatacttagagtcatctggttt

SEQ ID NO: 82460 - DNA, 513 bp, Homo sapiens
acctataataagaaatagattgaattagtaattgaaaacctgtccacaaagaaaagtacaggcaaaaatgacttcactggtgaattttaccaaacgtttaaaagtgaattaatgccaatccccaacaaactctccaagaaacagaagatgttttccaattttgtctatgaggccaatattaccctaatacaaaacctgaaaaggcatcatgagaaaagaaagtgaaagtgacaaatcaatatctcctaaaatataggtgcaaaatcattaacaaaacactatcaaaatgaatgtagcaacacatacacaaaaggattacacatcaagaccaagtgagatttattcaggagtccatggttcgtttaacaccccaaaataaatcaatgtaatagaatatattacaaaaatcacatgtcaattgatcaataagaagcatttgacaaacaaaatatcctttcatgtacaagtgtgcaacaaactaagagaaaggacctttcttaatcataaaatcta

SEQ ID NO: 82461 - DNA, 419 bp, Homo sapiens
ggctcattcaggtcaggcttctgaaccggcctcgtgcactaggccgcccggtgactacagtgctgggattacaggcaagagccactgcacccagcttctctgtacttttaaaactctacagatgattcccagattgggagccagtgctcttgcagaggttcccatgatgtggaccaggggacttctgatgcagcaggagcacagtttggctccagcattgtgccatctaggtacaccagcaagagctcccctccatgcttggcaaatacgggcatgtgagctgcccatctcatcacccttgcccttgatgtgacacagctcatgtcagaagcttgatttaacaatatagttgtaagctaacaaaaaaggaaacaaaagtatgatctttcctccaaagttgccttttcctgtcatacttg

SEQ ID NO: 82462 - DNA, 268 bp, Homo sapiens
agaataaggcagggattgagatttattttttacaaatagctaaccaatattccccaaaacatttattacttttcccttttgtcataaaatgctatctttatcatacatatttggtttgtcttctgaactctctactcttttacatctgtttgcctagcttgaccacagtatgagagtcttttttttttgagatggagtctccctctgtcacccaggctggagcgcagtggtatgatctcagctcactgcaacctctgcctcccgggtt

SEQ ID NO: 82463 - DNA, 216 bp, Homo sapiens
cattcactaaatatgtgcaaaggaagtttcaattctgagctgacttccaacatttttttcagggaaaatattatctctattgttttatgtctatgacaaacagcctttactgtagctcttccttttaatttctctttctcttgttccttctcttcttctgccagcttcttctcttctttcaccttctatgcctcattttccttatcttcttccttt

SEQ ID NO: 82464 - DNA, 293 bp, Homo sapiens
tgaaatcatcaagtcttctgtgcaaaaagaacatataacttacaaaggcaaacttacaaaaagcatcacatgttgaaaaactgacatacaaagcaaggcaacatagagcagtgtttttttttaaagctcaatgaaggtgtgaattgaaggattttatatctaactgaatgttctcaaatgtcaaggttatagaaaaagagttttcgacataacgaaaacctgggtaatttctgtacctgctggccatttctgaggaatatacaagagaatgagctttatccaaccaattgatg

SEQ ID NO: 82465 - DNA, 1544 bp, Homo sapiens
tcagtacaaatacaactgtcattcattgtcctaagtacgtgtacatgtcagcaacaatgtcaggatctgtggagtttgcgagtataagatctttaagtgttgaaggtttcatctccataattgcagctgctttagctacaaatattataggaagctgttccttctttttctttacatcaccaaaccttccagtggttataggcattttgttatccttcaagtgacctggagcctttgttgcatgacaggattgtacctgaagatcacattctttaacaattggacctactgaatctgtaaaactactagaagaaaacatattgaaaatacttcaggacattggtttaggcaaagattttatggctaatacctcaaagcacagacaacaaagataaaaatagacaaatgagactatcttacactaaaaagtagctgtgcaaagtaaagggaacaacaagagtgcagagaaaacctgttgaatatgagagaatatttgcaaactatgcgacaagggactaatatccaaatatacaaggaactcaaacatctcaacagcaaaaaatataaataatcccattaaagtgggaaaaggatgtgaacagacagttctcaaaagaagacatgcaaatggccaaaaagtatatggaaatatgttcaacatcactaatgattaggaaaatgcaaattgaaaccacaatgagatactctacttagaattgttcttactaaaaaagataaaaaacaacaaatgctgatgaggatgtggagaaaagaaaactttcactgttggtgaaagtataaattagaacaactactgtggaaaacagtatgtagatttctcaaaaacctaaaaatagaaccaccacatgatccagcaaaccaagtataaccacaggaaaagaaatcagtatatcaaagagatacttgcacttgcatatttatcacagcactattcatgataacaaagatatggaattaacctaagcatccatcagtggacacagggataaagaaaatgtttatgtacacagtggaatactatttggccataaaaaagagtaaaatgttattgctaacaacatggatggaacttgaggtcattatggtaagtgaaataagccaggcacagaaagacaaataccacatgttctcacttatatgtgggaggtgaaaaacttcacctcatggagatagggaatagaataagttatccggggctgagaaggggaaatgaagagaaattggtgaatatgtacaaatttccatttagatcaaaggaataagttctgatgttagaaagcatactagagtgaactatagttagcaaaaatatattgcatatttcaaagtagttggaagagaggacttgaaatgttaccaacacatagaagtggtaaatactcaagatcatggataccccaaatacgctgacttgaccattacacattctatgcatgcaagaaatgctcatgtgtaccttatatatatgtaaaatatgtatcaataaaagaaaatatataagatagttttaaaataaaaaattg

SEQ ID NO: 82466 - DNA, 1488 bp, Homo sapiens
tcagtacaaatacaactgtcattcattgtcctaagtacgtgtacatgtcagcaacaatgtcaggatctgtggagtttgcgagtataagatctttaagtgttgaaggtttcatctccataattgcagctgctttagctacaaatattataggaagctgttccttctttttctttacatcaccaaaccttccagtggttataggcattttgttatccttcaagtgacctggagcctttgttgcatgacaggattgtacctgaagatcacattctttaacaattggacctactgaatctgtaaaactactagaagaaaacatattgaaaatacttcaggacattggtttaggcaaagattttatggctaatacctcaaagcacagacaacaaagataaaaatagacaaatgagactatcttacactaaaaagtagctgtgcaaagtaaagggaacaacaagagtgcagagaaaacctgttgaatatgagagaatatttgcaaactatgcgacaagggactaatatccaaatatacaaggaactcaaacatctcaacagcaaaaaatataaataatcccattaaagtgggaaaaggatgtgaacagacagttctcaaaagaagacatgcaaatggccaaaaagtatatggaaatatgttcaacatcactaatgattaggaaaatgcaaattgaaaccacaatgagatactctacttagaattgttcttactaaaaaagataaaaaacaacaaatgctgatgaggatgtggagaaaagaaaactttcactgttggtgaaagtataaattagaacaactactgtggaaaacagtatgtagatttctcaaaaacctaaaaatagaaccaccacatgatccagcaaaccaagtataaccacaggaaaagaaatcagtatatcaaagagatacttgcacttgcatatttatcacagcactattcatgataacaaagatatggaattaacctaagcatccatcagtggacacagggataaagaaaatgtttatgtacacagtggaatactatttggccataaaaaagaataagccaggcacagaaagacaaataccacatgttctcacttatatgtgggaggtgaaaaacttcacctcatggagatagggaatagaataagttatccggggctgagaaggggaaatgaagagaaattggtgaatatgtacaaatttccatttagatcaaaggaataagttctgatgttagaaagcatactagagtgaactatagttagcaaaaatatattgcatatttcaaagtagttggaagagaggacttgaaatgttaccaacacatagaagtggtaaatactcaagatcatggataccccaaatacgctgacttgaccattacacattctatgcatgcaagaaatgctcatgtgtaccttatatatatgtaaaatatgtatcaataaaagaaaatatataagatagttttaaaataaaaaattg

SEQ ID NO: 82467 - DNA, 301 bp, Homo sapiens
cgtcagctgtcaggcacccacaatctgggtcagataaaaatcccttaccctggtacagagcccggcccactgttttggagtagcattcaacactcattcatgcaacatgtgtttttgcacatttgctattttctggcactgctttaactgctgtgaatacagtagtggctaaaaataaaagtccctgccctcttggagcttatattctagtaagagagacagacaataagcaagataaataaataaaatatagtgtgttagaaagtgatacatactaaggagaatggtaaagcagggagtg

SEQ ID NO: 82468 - DNA, 3483 bp, Homo sapiens
  misc_feature (2000)..(2001): n is a, c, g, or t
  misc_feature (2091)..(2091): n is a, c, g, or t
caggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaagatgcattatctatgatatgctaatatatgtatatgcaatatatataggctcttgctgatctctccagaggnngtgattatgagaagggggtgagaatgatgagttccttcaccaggagcaaaggacggggatcgtgtggaaccactgcagaactatttccgnaatcaactaagtggagagagccaggaaggctgcatcagaacccagtaaagcttcttgtctggatctgagctggtttgttttgtgcttgcttttccctgccttgccactcccctcactcttctcttttccccacagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaagattta

SEQ ID NO: 82469 - DNA, 2278 bp, Homo sapiens
caggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaagattta

SEQ ID NO: 82470 - DNA, 424 bp, Homo sapiens
aggtaaacagcatccttccacagcagcagttctcaagtgggatcttggaccagcaaggtgggtgtcacttgggaatttgttagaaacgcacattcatgggccccacccagcccgcctggatcagatgctctggaggttgaggccctgcagctgcacttgaagaagacttctgtgggattctgaggcacggaagccatcaagtgtccctgctctgtgtgcggcacaacagagaaagccacagacttgaggtcagcagaagcaaactcaaagcctacatgtgtatgctcacaggccatgtggacccggataaatcactgcacttttctgagcctagccccagcccctgtcaaatgaggagaagccggggtacaagagctaaatcttgacacatgtgaagaacagcagagcaaacttcagctctctt

SEQ ID NO: 82471 - DNA, 798 bp, Homo sapiens
tcagtctgtatcctctagatcatggacagcctattgatccttctaactctgcagcaaagcctccaagttaaaaaggaaaataagtctctcaacaccattatttattcagctgcacacagtcttgaactgctgaaatataaaaatgaaaccaaagcagtttccatctaatcacttttttaaaaaatgccatgcagaatatgtttatcacaatcaccatcatcatcatcatcaccactgctgttgccactgcatcaccatccaacatgaacaccaccaacttaatcatgtccctgattcaacagttttcaacttgtttatacataaaataatgacagagtgtgattgtttgccaaaaaaagtttttctatgagcatcttaataaccaagttataataacccagttatttccatcaacaaaaaaaatctgaatagcatttggtttgtctgtgtatcagcagaaatgcttatgtgaatttagcatttattataactgatgaagtccttttaactggagtgtattgtaataatatgtctgcaaaacataatatgtctgtgaaagataatgaaatattttagcatttgcaataaaaaggtactgaagtctcagttccttttcaactctaacaattatatcaacatctatgtcttactctttttaaaaagtgtgatgtgtgacttgatagaatacatgttaggaagtacagggctaattaacttggttgaggtggttacagaaggcttccataaggaattatattgtgattgagataggaaggaagagtagaaaatgcttaggtc

SEQ ID NO: 82472 - DNA, 293 bp, Homo sapiens
tcttattcaacacaaacaggataaataaaaagaaaaccacacttagatatatcatggtcaaactcatgaaagagggaatcttaaagcagctggtgaaaaatggcacgcagcatacaaatgacaggtgatcagcaacagagaagattgtaaagtgatatatctaaatcaccaacatcagggagtcataacaataaattgtatctgcttaataaaggaacttaaaaatacatgcagcaaaactgggtagaattaatgggacagaatcacaaatccacaattggagagttcaatta

SEQ ID NO: 82473 - DNA, 384 bp, Homo sapiens
cctctctctgtgcagttgaacttgatcagatgagatggcaaaagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtgaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttagg

SEQ ID NO: 82474 - DNA, 495 bp, Homo sapiens
ggaaatttaatctatgcagtgctcaggaaggttagggaaggcctctctgggaaagtgatacttgagaccagaaggatgagtaagaggtagccaagcaagagaggagagaagagcagtccaagcagagggaacagatgtgcacaggccctgtgactggaaggagaaagggatcaggataatctgtgaggactgagagaagactaatgtgctgggctgaagaaaggggggctgggtatagtataaaatgaggtgggagaggtgggctggagccagaccatgttaaagtattattcttgcttctctcattctccacataataggtcctatggattttattttctcaacacagtccatttcaaatcatcctcctctccccatttgtactttcacctttctgattcaagctgccctcatctctttcctggattaacaaaatatccccttaattgacctctttgcttccattcttactctagcccccataacattctccat

SEQ ID NO: 82475 - DNA, 290 bp, Homo sapiens
gttggccaggctggtctcgaactcctgacctcaggtgatccacctgcctgggcctcccaaagtgctgaggttacaggcgtgagccaccacgcccagctagtctcacattattaaaagcaatctgtatgctctcacctcccaaatagatgctttctctcccctgctccctttctatatgttgcccagctttctttctggaatgccagattcacattcctacctattaattcatttggatgtcagtaaatcttagatttaacatgtccaaagtgaactgcggatcgcctgcc

SEQ ID NO: 82476 - DNA, 759 bp, Homo sapiens
gggcccccgaaggatctcggaggcgaagttgctagaagatacgtaagagggccccagtggagatggaacaaccaaaggacggggctgggcctgaagggaacaacctgtccctgccgtcatctgggaccgagccatggccccctgcgcctctcccagcccctccacccttgctcctgaactccacagaccccacccacctggggctcccggagagcgtggcctctgtcaccgtgcccatacgcctggacaccctctcctgcctcctgcacagcgccctgctgggggcctacaccttccaacaggccttgccctcttgcccctgctgctcccaggcaggccactcccagccgggggcagttaggaggcctcccaggggacgcggaggctgggaagtcaggcacaggccaggctggggccgaggcctgcatcgacggggccttgggagagctgagcagccagagaggggccgggcggggggccctggggctggccccaggaccccaccaatgacactgccatcaccaccaacactgcctgcccaggatgggaagaaagaagctcgaggtccagagccacccctggaaacaccactggctgctgaggactgggagacagagtactaggaccttggagggtcaggcacctgagattgcagtcacccaggagggttttcctggggcccagagtgatctcagccctgtcagaagaaccccaagaaacatcttccatcctcccctctccccaaaaccacaatcccag

SEQ ID NO: 82477 - DNA, 420 bp, Homo sapiens
gtgatcttcccaccttggcctcccaaaatgctgggattataggcatgagccactgctcctggcctttttatgcacttaataaggatgagtcatctaacatatttttgactgtttcctttgaaaatttgcatctggattatcatatcctctggaatgtgccctctgttgtatcttggtgtctcaattgaaatttgtggtatttatatacattataaagtaatgctacatagagaaacatgattatttttatgtcagtttctaggaaataattatctacccacatatttaccatttgaaaagctcttcattctttcttaaatatctgaatttccatctgttaccattttccttctgcctgaagaacttccttttgtattttttgcagtgtaggtctgctagcaataaactctcttggtcttc

SEQ ID NO: 82478 - DNA, 472 bp, Homo sapiens
tgaagctggatcagatgcccacacctaggcctctaattgtccagatgatgaaattactatgactgacatagaccaaacatcattctcctcctaggataggtaaacagcctttcctccctgagatcagtgtaattccacctgtaccaaaagaatgtgggactctgttggcagggaaggagacaagtgagaatggttgttggtagattagacaacatgtgtctgctgtgtgtctagctcttctgctctaagtttcttgaagcagcttttttttttctgctttgtttacttcttgtttatctttgtatctttaataactggctttagttcctggccatgatttatactatttgccaaaatgaatgaaataaaatgatgcaacagatatatatggattaattttttcactaaataatatgtcacattaatgagatagaaacataggcaaataatacatttggtaaggcaaaacgac

SEQ ID NO: 82479 - DNA, 1157 bp, Homo sapiens
taagtgaaggaaatgagacccggagaagctggacagcttgcctgcccaaagccatctggttatggctgagcttagcctagaatttaggtcttggcttccagcccagaactttctccactacacagcactgcttgtcagagtacttaatgtctaccttgctttccatttttaaagtttacattttgttgtaagattatctactttccaatttggtcactaactagaagacttacccagtcccaaacaattatcagattatatggaaaattgaagatacttaattttgtctgtcaacatgttccagaagaatattttttggggaaaatggatttacaatcaacaaataaacaaaaatgatggcatgtttccatgttttctttttaattggatccttatcagagtactcccaatcagattcttctccagtttagagttttcccccaagagattcagctcatccaagaaaaaggtgagaaggtcctaggcagtactagagtgaagcctgcctgattctcagctgattggccaaactcagaactctctcggtgttctgggtgcttttgacagacagtgggacgcacctccccaccccagtactgctgacacagtgtcttccctctctctctctggaccttactcccaagaattagtgagaagcccacagatgtgtggagaacactaagcataccctgggcaaacagccattcgcacatcagaaaatattagaaacttattgtgaggaacagagggggaacaaaaaagaaaaaggaaaaaaagcaggtctgtccttgcatatatacaatgtctgtggaagtctcacttttaatgccaactattatgaaactacttctactctgatcaaattatatactaggtgccaaataaatggtgttaaattgaaaacaaaataatgagttgattaaccattattttctttcaagccagaatacaagctacagcattacatttaagcataaatgtgaatttatattttatagttttcaactatctaaatttcctttttaacttaaatactattattgttgttgacagattaggctactattaccatgattttttttaaagtacttccacctaattttaatggaccaattattaagacttatcttccaatctggtaaagagatatgtaacgg

SEQ ID NO: 82480 - DNA, 515 bp, Homo sapiens
gatgttgtgcacacatggaggaggggtggcctaactataactaatacatggagatcatgcttggagtgtggttttttccttggatttagtctgttctcttacttgcctctgattccctggaaatgtgaaaaccaagtagaaaacaatttatgaacatacagaaaaaacgcaggatacagattcgtgattatgtttttttttttttaaggtttcagtgaactgcctaaaaatatatgcaaaattttgtttttctgtacttttcagttcagaagaattagtaaagaatttctaagtaaagccaaatttacttttatgatattatgtatgtggcagaggtgtatggggaggagtggatcacagaactgttggagaggaataaaggagtggtagtagtaacgatctacaagtcttttattgactgaaatagtatgctatgaaaataaagtcacaggttaagataggtgagagtacattttctcagagcatgttggatttttctaattgtatagtgaaag

SEQ ID NO: 82481 - DNA, 575 bp, Homo sapiens
ctaagaagtttagactcttatgccagtgtttcccagagtgtttttgcaggaataatgggtatgcagaattaataggtgttacatgtaaagggcttttgttgccagattagcttgggaaatgcagagttaatgcttacattccaatatgaaacagagagacttttagagactgtaatttttagatagctgtattatagtgagtcctctgggactgtttggttcttttggtatgatggtatttttgttatgtcaaatactgtctgaaaaaattataagaaaatatgtgttctttttggccgggtgcggtggcttaccgctgtaatctcagcactttggaaggccgaggcaggtgagtcacctgaggtcagaagttcaagccaacctggccaacatggtgaaaccccatctctagtaaaaataaaaaaaattagtctggcatggtagtgcgtgcctgtagtcccagctactttggaggctgaggcaggagaattgcttgaacctgggaggcggagggtgcaatgaattgagattgcgccactgcactccagcctaggcgacagagcaagactccatct

SEQ ID NO: 82482 - DNA, 765 bp, Homo sapiens
caggaggacaccttggggcaaggttggcatgtctgctcctgcctgaacccacacagttcctggagtgcagcaggtgctcctcagctgtttgctgcacgcatggacgtaagagtgacagaagcatgtccttcgacatgacgtttttgtacctgaacattgtctagaggctttccagactgtaagctctgtgggattaggagcctgcctgcctcgcactccctggcatccttagtgctttgggcctcacaggccagcggagccctcgtgcgggttccaggcctgctttggtgggagtgctcagtacttttagccacacagagccgtggcctgcaaggctttcggagtacatctctagcacatctgagaatccggaagcaactcagagtttctggaatggatttcacaaagtctgtgaataagaaggccccacaggccctactcaacagcttttttttttttttttttttttaaatacagaagatgctagtcttcaaagaacctctttactcttttactctttttctttttttttcgagacagagtctcattctatcgcccaggctggagtgcagtggcatgatcttggctcactgcaaccttcacctcctaggtgcaagtgattctcctgcctcagcagcctccagagtagctggaattacaggggtgcgccaccatacttggctaatttttgtatttttagtagagactgggtttcccaatgttggccaggctggtctcgagctcctgacctcaagtgatccaccc

SEQ ID NO: 82483 - DNA, 632 bp, Homo sapiens
ctctggtctcctgactctggcagggggaacatttgcactgttcttgttccttaccccaggagctggcctattgcacaacctcaggaaacagcccctatgcaatcctggcccacagagcggacatgttctggtttttattcagcagcttttttatgaagtgtgttttcctttcccatcatgtcatctggaagcaattcctcccaacagctggatttgctttcacaattggtaaacaccgcgaatggaaggccggggacgatgcggagctccccggaggagccttgtccccacccgcttggctcgcgttctgaagcttatcgcgggtgcctgcacaagcctcatcaaaatcgagggcgtcctccagcaggcgacccacattgcattccccgcttaagagggtcaacgtgttcttcgggggagaaattttctgaatgctttgcagataaaattgatcagatgcaggccagattgccagctgccggggccgcgtgcgcctgtggaggccccaccagcgcggggcaccagcgcctcggggtccgggggaggcctctctctgcaccgccgccaccaaagccagtaagagagggcaaaaccccaaagagcactgactgggccgtcaaggaagatgaatg

SEQ ID NO: 82484 - DNA, 408 bp, Homo sapiens
tctctgcctccagggttcaagccattcttccgcctcagcctcccaagtagctgggaatacagttgcgcaccaccatgcctggccactttttgtatttttagtggagatggggttttatgttggccaggctggtctcgaactccagacctcaggcaatccgcctgccttggcctcccaaagtgctgggattacaggtgtgagccaccgcacccagctggcctcctgttttcttgataagaggtgaggtactttgctcatgaatttgagtagaggatgtaaagtttaaagtaaatgatgaaaatgtggactaagccattgagagggatagggaataagctgacaacatttctaaaaatattgttggtagcattgagagtgctcagttgacatcattagttcatagcagtg

SEQ ID NO: 82485 - DNA, 1318 bp, Homo sapiens
acttccgctgtcccgcgaagggcggggggagcgaactgttgtggtgcggagcgttcggcgggcggcggccgggcggcccaggggctgccgcgggactcggggcgcagccgagtggctgcaggggtggagtgggccggacgagccgcggggcccgggtgccgcgggttcgaggccgggccccgcgcgaggaggccgcgccaccccgggggagctgcccggcagcgagtttgccccgctgccgaaagaaggcgggagccggcaggggccttcgaaaccccctggcaacccaggcccggagtccttggggagcggctgtttcctgggacgccctcccggacacccccgctgcagggttacggttctgggcccccggcagaaggctcctccgggtgacccccggcggggccctgcgagccgcgggagccgaccccggggcctcgagccgggaggaagggggcttccggaggcggagggccgggggccgagggagccgggcctctcggacgcggggcagggcagcgcccgggctggagacggactctgggaccctcggctgcgggggtctcagcgacctgccccgcggcaagcgcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgtaaggcacctatatatctgtgattttcacaaaaatttcatccagagtgtccgaaataaaaggaagaggaagacaagtgacgatggcggagattctcccgagcacgacactgacattcctgaggttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatga

SEQ ID NO: 82486 - DNA, 2366 bp, Homo sapiens
  misc_feature (1320)..(1320): n is a, c, g, or t
gcggatttcctgccagcttacttttatctttaaggatttaaggaataaactcaaattcagaagtctctgcagaacatttgtgcaacagctgtttcagtatcaacaaccccaagtcatttgctgggcattcagtttctgtaaagtttttcagtggttcctccagccagccttggaggattcttcatgtcttagctgttgctgccaccttcacttaccagtgtgcctccagcctgtattagaaaatctgtagtatccaccttcttgtatgtggttctaccttgtaagaacttccacatctttttccacttttctttgtggatcagatgtgagataatgcaagaattataaattgacacatagaaacaaagtttttcaaagagttattatcctacaatagtagctattgtaattgtaaaaatagagtgtcccaaataccgttgcaacagtcccttgtgtcctgctttcctcctccccaggacagtacattccagtcgactataagtttatgactcctacaggtcttctaaaaatgtcacatcacttcctgcttccttgagggactctgtcttgtcggaaggaaagtctaagctgttctcatgcccacccccctgatgcctcactttttcattatgctcctacatgggcagccatcatcacccaactgacactgtaccctgggcctcctcactctttctgtcatcctccattggaaactctaaagtcttggcactcctacccatctggaatgcttcctgtctgcctaaagtcctcccttttagtcagggcccttcaccctgagcatctctgttgcagggatctcttcctttgctgaatctgtaccatttactgtcttcaccattcactggaagtttggtgtatgatacgctgccaagtgtgatgttagcattctctttgtgttctgcaactcagtagtgagcttctgggaatgatggcctacatcttgtcttccatctatctctccaatgccctgcaatggaaggaagccccgcaattcgacagatacctattgctgtctccaaggaattggccaactctgactttgatttttgtctccatcaggtaaggcacctatatatctgtgattttcacaaaaatttcatccagagtgtccgaaataaaaggaagaggaagacaagtgacgatggcggagattctcccgagcacgacactgacattcctgaggtaaaggtcaaagaaaccagttgcggaagctggaagaatggattctaatctgattctcacctctggcctggtctgctttttgtgttaagaagtaattttagtccttttgttttgctntggattatttgaaaagtgaattatagtaatatggaatctgagagctaaaagcttggacacccactggtcagactgccccatcattttacagacaggcacagagagccgaggtcatgtatatagtttggaggctctagtctagggccctttccagtagaccacactgcttttctgcaagacgcccctgacgaatgcgtaaatacaaccacagtgtcacttttttttaaaccttgtttatgcctttagagagtgtataatggtttgggagaagtcttttccccaaaaaatgaaggtgtaagtcatcagttcataccagctctgattttctctcactgatttcttgacatctagtccaggctgttcccaaggatccatttcaaagttgactaaactggacccggttttctcaactctagcactgttgacatttggggtcagctaatttttgttgtggggactgtcctctgcattgtaggatatttaacagcatgcctcagcagcatcccctcgtgagattctacccatcaccaccctgagtcatgacaatcaaaacgtgtctccagacattgccacacctcctttacaagacaaaatcgtcctgtgttgagaaccactgcgctagaccatgagacctaggcttctcaaactggaaggctgccttcccttcaggtgcccgtgtctattaagtgaggcttcaggaaggaatattggattttctttctactaaattgttttcactcaagactcagcaagagaagaaccgtttatagtgtacattgaatatttgacacatgaatatttcataaggcaaccgcctgttagcactcagagtgaaaatgactgtgtaggaatagaaagagtaggcgggcctttgtctgcagatgtggaggaaaccgttgaaaatctggccctttccctctgcccctccctgtgtccccttttccaatgttggtttacagaatcttgcttttgcctttaacgttattgttattttacaaagaaatggacgtattcgatttctaagtggttttcaccaaaaaaaaaaa

SEQ ID NO: 82487 - DNA, 1034 bp, Homo sapiens
cctagcaaagagctatttgaggataacagccctcctttgtgctcctctatccggtcgctgcctcgttctggcctatcatcctccaggatgtctctggtttttgcctttgctctccatctttggtgtcccttctagcatcactgcccctccaaagctcagcctcttcatctcattctgattgttgctatagcatctccctccgtatccccccatcagtcttcccaacaaccaccaccagacccatcctgcgccatcgccctccaccctctgtgatagctccttctgtttttctggatgtgctaccatccattctcaccttttaaattcatcacagttgcctgtgacccccttgcccatctgtgcctctcccagctctctgtgctgtgatcttttcccctattccctaccgtttctcagtgctttatcagaccctgctcctccttagcttaagctttaccttttccaccagttttgtgagatcagcccaccccagccagaactgtttttctactgttatttttgccctcctagccagttactagtcctcaatagaccatttctaagacctcttttgaagccctccccatcctcacccctaccttagtgtagtgctaggcacatagtgggctcttggtgagtcctgggtggtcaggtgatggataacatttttctcctcttctccctaggtgttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatga

SEQ ID NO: 82488 - DNA, 2135 bp, Homo sapiens
  misc_feature (1089)..(1089): n is a, c, g, or t
acttccgctgtcccgcgaagggcggggggagcgaactgttgtggtgcggagcgttcggcgggcggcggccgggcggcccaggggctgccgcgggactcggggcgcagccgagtggctgcaggggtggagtgggccggacgagccgcggggcccgggtgccgcgggttcgaggccgggccccgcgcgaggaggccgcgccaccccgggggagctgcccggcagcgagtttgccccgctgccgaaagaaggcgggagccggcaggggccttcgaaaccccctggcaacccaggcccggagtccttggggagcggctgtttcctgggacgccctcccggacacccccgctgcagggttacggttctgggcccccggcagaaggctcctccgggtgacccccggcggggccctgcgagccgcgggagccgaccccggggcctcgagccgggaggaagggggcttccggaggcggagggccgggggccgagggagccgggcctctcggacgcggggcagggcagcgcccgggctggagacggactctgggaccctcggctgcgggggtctcagcgacctgccccgcggcaagcgcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgtaaggcacctatatatctgtgattttcacaaaaatttcatccagagtgtccgaaataaaaggaagaggaagacaagtgacgatggcggagattctcccgagcacgacactgacattcctgaggtaaaggtcaaagaaaccagttgcggaagctggaagaatggattctaatctgattctcacctctggcctggtctgctttttgtgttaagaagtaattttagtccttttgttttgctntggattatttgaaaagtgaattatagtaatatggaatctgagagctaaaagcttggacacccactggtcagactgccccatcattttacagacaggcacagagagccgaggtcatgtatatagtttggaggctctagtctagggccctttccagtagaccacactgcttttctgcaagacgcccctgacgaatgcgtaaatacaaccacagtgtcacttttttttaaaccttgtttatgcctttagagagtgtataatggtttgggagaagtcttttccccaaaaaatgaaggtgtaagtcatcagttcataccagctctgattttctctcactgatttcttgacatctagtccaggctgttcccaaggatccatttcaaagttgactaaactggacccggttttctcaactctagcactgttgacatttggggtcagctaatttttgttgtggggactgtcctctgcattgtaggatatttaacagcatgcctcagcagcatcccctcgtgagattctacccatcaccaccctgagtcatgacaatcaaaacgtgtctccagacattgccacacctcctttacaagacaaaatcgtcctgtgttgagaaccactgcgctagaccatgagacctaggcttctcaaactggaaggctgccttcccttcaggtgcccgtgtctattaagtgaggcttcaggaaggaatattggattttctttctactaaattgttttcactcaagactcagcaagagaagaaccgtttatagtgtacattgaatatttgacacatgaatatttcataaggcaaccgcctgttagcactcagagtgaaaatgactgtgtaggaatagaaagagtaggcgggcctttgtctgcagatgtggaggaaaccgttgaaaatctggccctttccctctgcccctccctgtgtccccttttccaatgttggtttacagaatcttgcttttgcctttaacgttattgttattttacaaagaaatggacgtattcgatttctaagtggttttcaccaaaaaaaaaaa

SEQ ID NO: 82489 - DNA, 1081 bp, Homo sapiens
  misc_feature (1038)..(1040): n is a, c, g, or t
cctagcaaagagctatttgaggataacagccctcctttgtgctcctctatccggtcgctgcctcgttctggcctatcatcctccaggatgtctctggtttttgcctttgctctccatctttggtgtcccttctagcatcactgcccctccaaagctcagcctcttcatctcattctgattgttgctatagcatctccctccgtatccccccatcagtcttcccaacaaccaccaccagacccatcctgcgccatcgccctccaccctctgtgatagctccttctgtttttctggatgtgctaccatccattctcaccttttaaattcatcacagttgcctgtgacccccttgcccatctgtgcctctcccagctctctgtgctgtgatcttttcccctattccctaccgtttctcagtgctttatcagaccctgctcctccttagcttaagctttaccttttccaccagttttgtgagatcagcccaccccagccagaactgtttttctactgttatttttgccctcctagccagttactagtcctcaatagaccatttctaagacctcttttgaagccctccccatcctcacccctaccttagtgtagtgctaggcacatagtgggctcttggtgagtcctgggtggtcaggtgatggataacatttttctcctcttctccctaggtgttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaaaannntaaatctttttggtcaggaggattatattctcatgattcag

SEQ ID NO: 82490 - DNA, 448 bp, Homo sapiens
tttgaaaaagaatgaaggactttggcccctcatattgatcattcattttgtttttaagtgctctccacctgcctgaagcaagaacagctcttttagaggcaggttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatga

SEQ ID NO: 82491 - DNA, 495 bp, Homo sapiens
  misc_feature (452)..(454): n is a, c, g, or t
tttgaaaaagaatgaaggactttggcccctcatattgatcattcattttgtttttaagtgctctccacctgcctgaagcaagaacagctcttttagaggcaggttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaaaannntaaatctttttggtcaggaggattatattctcatgattcag

SEQ ID NO: 82492 - DNA, 376 bp, Homo sapiens
gaagttcttcagcatttgtcattcccgccacagcatgcaaacaactccattcgcttctttgtacaatgtagaatttgcggtgtgatttgtgcatggtttaaggaactttggtattttccccccacatagactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatga

SEQ ID NO: 82493 - DNA, 423 bp, Homo sapiens
  misc_feature (380)..(382): n is a, c, g, or t
gaagttcttcagcatttgtcattcccgccacagcatgcaaacaactccattcgcttctttgtacaatgtagaatttgcggtgtgatttgtgcatggtttaaggaactttggtattttccccccacatagactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaaaannntaaatctttttggtcaggaggattatattctcatgattcag

SEQ ID NO: 82494 - DNA, 1362 bp, Homo sapiens
acttccgctgtcccgcgaagggcggggggagcgaactgttgtggtgcggagcgttcggcgggcggcggccgggcggcccaggggctgccgcgggactcggggcgcagccgagtggctgcaggggtggagtgggccggacgagccgcggggcccgggtgccgcgggttcgaggccgggccccgcgcgaggaggccgcgccaccccgggggagctgcccggcagcgagtttgccccgctgccgaaagaaggcgggagccggcaggggccttcgaaaccccctggcaacccaggcccggagtccttggggagcggctgtttcctgggacgccctcccggacacccccgctgcagggttacggttctgggcccccggcagaaggctcctccgggtgacccccggcggggccctgcgagccgcgggagccgaccccggggcctcgagccgggaggaagggggcttccggaggcggagggccgggggccgagggagccgggcctctcggacgcggggcagggcagcgcccgggctggagacggactctgggaccctcggctgcgggggtctcagcgacctgccccgcggcaagcgcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgtaaggcacctatatatctgtgattttcacaaaaatttcatccagagtgtccgaaataaaaggaagaggaagacaagtgacgatggcggagattctcccgagcacgacactgacattcctgagtgctctccacctgcctgaagcaagaacagctcttttagaggcaggttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatga

SEQ ID NO: 82495 - DNA, 1365 bp, Homo sapiens
  misc_feature (1322)..(1324): n is a, c, g, or t
acttccgctgtcccgcgaagggcggggggagcgaactgttgtggtgcggagcgttcggcgggcggcggccgggcggcccaggggctgccgcgggactcggggcgcagccgagtggctgcaggggtggagtgggccggacgagccgcggggcccgggtgccgcgggttcgaggccgggccccgcgcgaggaggccgcgccaccccgggggagctgcccggcagcgagtttgccccgctgccgaaagaaggcgggagccggcaggggccttcgaaaccccctggcaacccaggcccggagtccttggggagcggctgtttcctgggacgccctcccggacacccccgctgcagggttacggttctgggcccccggcagaaggctcctccgggtgacccccggcggggccctgcgagccgcgggagccgaccccggggcctcgagccgggaggaagggggcttccggaggcggagggccgggggccgagggagccgggcctctcggacgcggggcagggcagcgcccgggctggagacggactctgggaccctcggctgcgggggtctcagcgacctgccccgcggcaagcgcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgtaaggcacctatatatctgtgattttcacaaaaatttcatccagagtgtccgaaataaaaggaagaggaagacaagtgacgatggcggagattctcccgagcacgacactgacattcctgaggttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaaaannntaaatctttttggtcaggaggattatattctcatgattcag

SEQ ID NO: 82496 - DNA, 1195 bp, Homo sapiens
acttccgctgtcccgcgaagggcggggggagcgaactgttgtggtgcggagcgttcggcgggcggcggccgggcggcccaggggctgccgcgggactcggggcgcagccgagtggctgcaggggtggagtgggccggacgagccgcggggcccgggtgccgcgggttcgaggccgggccccgcgcgaggaggccgcgccaccccgggggagctgcccggcagcgagtttgccccgctgccgaaagaaggcgggagccggcaggggccttcgaaaccccctggcaacccaggcccggagtccttggggagcggctgtttcctgggacgccctcccggacacccccgctgcagggttacggttctgggcccccggcagaaggctcctccgggtgacccccggcggggccctgcgagccgcgggagccgaccccggggcctcgagccgggaggaagggggcttccggaggcggagggccgggggccgagggagccgggcctctcggacgcggggcagggcagcgcccgggctggagacggactctgggaccctcggctgcgggggtctcagcgacctgccccgcggcaagcgcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatga

SEQ ID NO: 82497 - DNA, 1182 bp, Homo sapiens
gagtgcagcaacccaagggtgtcttaatctgaaataccaccaggaatgtctggacacagtagacaaagttttttcaactggacgccttaggatacatgcttccaaaaacaaagtagccaaaaagaaaccagagtcacagaatatcagagccaaaggaacatttggaggtaattcagtacctcctccttttcaacctacaggggagatagtggaagagaagcagggatgggtctgccttctgtgcccacaattcattggagattgttgtggtgaagaatttcttttatgatgaaggagaaataaactcccatcagctttaattcaggcaggtttattgaaaaggtgaagaagcatcttgcagaagcaaagcatggctgaggcttgtgggctctgtctggacaaatgagcagccgacagtggctgatgctgcccctgactctggggccgtgcggtctgtggttctctgtgagcatctcttctattctcttgcaccttccctcagcctggcagtctctgtgtactcttcaacccataattgagcgaggctgtaccagccccaatgccatgtagcactttatgtcaaattagaaaggcatgaaataaactagccctttataatacaactgttggaacaacagttgaaaataacaatatcttgactcctggttgagtgctttacgctgagctttcttttccgaatatgagcacagacttggggatattagtgtcacctagcgttattagctagtattctccttttgtttccccataacatcccctcctccttcccacagatccactctccactcatttccatcctgtcttatgccacttggggcttgtcccttctagaatgcatccctggctcccctgtgtgcacacttgcagttaggtttagcagtgggggcacctgatggagcctggaagtgagaggaaggtgaggtccgtatttcttccctctccctccctgctctggcactgagtatctggcaatagctgcatctgtctattacttcagtggccactcttccacagacgcaattctcagtgggtcccatagcattatttacctttgttcctttagctcccatcaaggaagacccagaggcattctcctcaccaaggcattaagaaatgcatgggtgaggggaacagcggcgtgcgtgtaaaggtcctgtggca

SEQ ID NO: 82498 - DNA, 598 bp, Homo sapiens
gagtgcagcaacccaagggtgtcttaatctgaaataccaccaggaatgtctggacacagtagacaaagttttttcaactggacgccttaggatacatgcttccaaaaacaaagtagccaaaaagaaaccagagtcacagaatatcagagccaaaggaacatttggaggtaattcagtacctcctccttttcaacctacaggggagatagtggaagagaagcagggatgggtctgccttctgtgcccacaattcattggagattgttgtggtgaagaatttcttttatgatgaaggagaaataaactcccatcagctttaattcaggcaggtttattgaaaaggtgaagaagcatcttgcagaagcaaagcatggctgaggcttgtgggctctgtctggacaaatgagcagccgacagtggctgatgctgcccctgactctggggccgtgcggtctgtggttctctgtgagcatctcttctattctcttgcaccttccctcagcctggcagtctctgtgtactcttcaacccataattgagcgaggctgtaccagcaaagcaccagcacaagaaaacacagttaccagacaagaccaca

SEQ ID NO: 82499 - DNA, 378 bp, Homo sapiens
atttcataatactattttgtgtagaaaccattactgtttgttttgtatttgtgtaggtaaaaagtattatgaaattatgtaattacagtattcactctgccaaaaaaaacaaaaataattataactcgggtatctaatgattgaacatttagtaattcttccctgacaaaaagagaaaaatattataactcaggtatctaatgattgaacatttagtaattcttccctgattataaaagtagcacatttatactttggaaaataaaacagcatgtatgggaaaaagtaataaacatagagaaattccatcacctcccttcccctctcctccaagaagcttgagcccaggagtttgggacttgcctgggcaatatagcg

SEQ ID NO: 82500 - DNA, 155 bp, Homo sapiens
tagctcaggccccaccatgtctcaccttgacatctgcagccatctcctcattggtcttcctgcctccagtctttcccccgtgattcattttctgcactggggatgatctttctaatttccaaacctgatcaaaaccctttcgtgactctgcatta

SEQ ID NO: 82501 - DNA, 867 bp, Homo sapiens
gtgccactgaagatcctggtgtcgccatgggccgcgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggtgagcttggtctgggccttttaaggcagttggagtctctacattattaggcttgcattattttatcagagcatagaggtggccccagtgactcagccactatggctactagaaaagccaaggctggcaagtgactttcagtggtcactcaggaccccttcctgcagatacaaacaaagcatgagtaagtcttagcaagctcttccccacaggttaggggaaacactggtgatgggagtagctcttcttgcttttagctgaatgacaaccatcttgccagcaggtagctgaagctggcagaggagcccagtggcgccttttcagtggttcttgggatgctccgcagccaattaagccgactgagttcctttcctcatggggacccgtgtgcaatggctgcacacagcagcttccttggtagtgtacgcagcctgttggttgtatgggttgctctaagggaccttggagacaggcctttccgatggatgttcatgtttctaaccttgcactacc

SEQ ID NO: 82502 - DNA, 4972 bp, Homo sapiens
  misc_feature (4867)..(4867): n is a, c, g, or t
ccaacattatttttgtgcagatttcaattcatgctgcactcatcctgggggcaaaagttaaaggttttctaaaaagctacttagtgaatgtcttagttaatggaaaagaaaataagtcaatccttttttttctaaccttgaagttgcaaagattgacaatgaactctgtaatggtgcattctcctcttgtgtggtttttgaaagctgagttatccttcctgtaatgattctgcacctgcaaactatacgtggcttcctccaggcagtaaatctacagcccaggctccctgcatcttatggctccaatcactttggatctcatcgtcgcctgcacattgccatacacagggaaggagaagagatggagaaggcaaagactttctgaaagccgtggctaaaagctggcatgtgtcacatcagctcacattccattgtagagacggggtttcaccgtgttagccaggatggtcttgatatcctgacctcgtgatccgcccgccttggcttcccaaagtgctgggattacaggcgtgagccaccgctcccggcctggcaggcattcttgaggcaaacgggaaatgggtgaacgggaggaacattggcagcacttgtggtctgcaccaagaactgaatcgaatttccatgtgttattgaatgttcacaaagaccttgtacagcgagtgttactacctctggtcaatgattcaactcaaggctcagaaaagtcaagtgtcttgtccagggacacttagtcagaagtgaatccaaggtttaagctcaagtctgcctaactctgaatttcacagccttttgctacatatggcgaataatatatccctgagcactaaaggcagactccaaggatcttgtctctgcaatcatcattctggccataatttatgaaaagcaacccaaagtatgtgatgtaataaaaagtactatctatgagtttacccttccaaaaattgaactgaattctgagctctaaatttggaatcaaaagaacttttctctgcactaatcatttggaacatcacttaaagaaaacaacgaaaaactggtgtcccctgagagaaagcaatacaaaacattatgcataaagaaatccttccaaaaaataaaccaaatccagtcaaatctctagttttgactcctagcttaccggaaatacgtgatgggaaaaaaatgaaatgacaccactatgattcaatcagccaaatccagcatatgcaaatttctaccagataaatggtttagtttcttccccaaacaaatggcacaaggaaacggaggtaagaatgggatgctgttatagattttaaaagatttaagaaagtataaactaaatacactatgtgcatcctctctgaacgtgcttcaaacatatcaaggggtcaatgagcagttttgaaacaataagggaatttgaacactgaatggttgtcagaagatagtaagagatcattattaattttactagacataatgatgttctgattttgttttttttttaaaaaaaaaacagtgttatttcctttatagatacatcatatagtattaactaatgaaatgctttgatatctggaacgtttaaaaaatattcccgatggagtaagtgcaaagaaacaggtaagcaaaatgctgataattgctgaaacacaggatgtgtacctggggcttcatttactatctcttcattttctattttgatatttgttggacattctcataaaaaggaaagttatgttttattttctcataagctagtaatgaaatagccctacgtaactgatattgtagagacaagaataggtgtaatagagcttaaggttttcatttaaaaaactatctgtagacttcaatggatcttaggtggcatccatgcaataacactcgtggaacatgcaggacaggtgtggagctccatcttcacacagtgacattttttatgcttctgttttccctaagagtggagtgagaggatgattattttatatcatggacttcttccctgctatactttttttaattattttactttcacttctgggatacatgtgctgagcatgcaggcttgtttacataggtatacatctgccatggtggtttgctgcacctatcaacccatcatacaggttttaagccctgcatgcattaggtattcgccctaatgctctccctcgcctttccccccaccccctgatagcccccagtgagtcatattcccctccctgtgtccatgtgttctcattgttcaactcccatttatgagtgagaatatgtggtgtttagttttctgttcctgtgttagtttgctgagaatgatgttttccagcttcatccatgtccctgaaaaggacatgagctcattcttttttatggctgcatagtattccacggtgttatatgtgccacattttcttaatccagtctgtcattgatggacatttgggttgtttccaagtctttgctattgtaaatagtgctgcaataaacatatgtgtgcatgtgtctttgtagtagaatgatttataatcctttgggtatatgcccagtaatgggactgatgggtcaaatggtatttctggttctagatccttgaggaattgccacactgtcttccacaatggttgaactaatttatactcccaccaacagggtaaaagcattcctatttctccacatcctctccagcatctgttgtttccaaatgttttaatgattgccattccacctggcgtgagatggtatctcattgtggttttgattttcatttctctaatgaccagtgatgataagctttttttcatatgtttgttggccacataaatgtcttcttttgacttttatgtggaaacaaatttaactgcacagagaggtgaaaattaattaataacttttaaagtaattccctaagtttctaaggatctatatgtttccatctgactttattttatttaagctcttgattgatgctgcatttggagcaggttcatgaacatgaatagagttaatctgggacagatttccctcatttgattttttcactgtttccatcacagaacttatttcatgctcaccatgtttgcaggcattgagcttggtactggagccacagagctggatcagacagacttgtgcaaatatttcaggttttttttgtgggggggtcatatttatagataaataacagtaaagagtgacgggttcttatgaaaatgcatacacagtgaagtagagggtgaaaaggagggatgtgttctatgaggaggaagagtgataagaaagtgtaaggggatgtgtctgtgtctagacatatgtgtgttcacgtgtgtgcgtgcttgtgtgtactgcatgtgtatatgtgtggccatgcacctgtgtgcatgttcatgtgtgtgtgtgtatgtgtctgtgttgaggactaaattaattgggcttatggaagcagggagccactgataggtttaattagagactgacatgatatgatagtttaggtggatttctctgggggctgtgttgagggacagtggggaggagagctagaaggaagaaaaggacacatgcataacagaagcaatatctgtctatgggatggtggaaagaatcagaaaagacttaataaaacatgtgacactttaactgaatcttgaaatagacaagtgttggaggagggagttggaccagatacttcatgcaaagggaagaaaagtgcacaaacaaaatatgagaaacaaggcagacaggcatttttttaaaattttcgcacccactgatagaccagtgatgcattcacatcgtctgcattcatgatcaacaaaagtgctttcctagaacatgaacctcaacccaagtgtcgcctcaagtagtgtatgcatgaactcaagcattaaattagaattgattttttaaaaaactcacacaaacagatgtattatttaaaaatctttaaagcaggtttaaacagttttcaggattaaaagcagccactattagaaagaacaaaaatacatttgacataaatataaggagcctcaatagaacctcctgtacccagtcattgtcaatgccacatccattcattcaccagcccttatatcaatgcttgctgggctcacttaccacgatcagcacgtgcatgtccttatctgaaagcttgccactcaaatgtgctcagtcttacctgtgtggctgggagtgttggggatttaatgtcaagggaaagaatcttccatcaatgaatgatgaaagttagttttcacaacttccggtccccttggccctcatcaaagggctccaggtgaggtttgggctccttgctatcctccgagtttccacggtagttttaagcaccattgcccgtggtaatggctgacattgatactgcactttttttttatttaagatggagttcccctctgccacccagactggagtacagtggcgcgatcctggccatcgcaacctccgcctcccagatccctcctacaacacatgagaattgtgggtgctacaattcaagatgagatttgagtggggacaaagtcaaaccatatcattagataggacactggagaaaggcaagaaagaaaagacatctgaagaatgaagggagccaaagaaatgccaacattttgctttttgaagaaaagctaaattaaagtcaaaatggatttatcaatttccttgggttcgtgaatgtacagaactttattaagactgtcatgctgtcatcatggctggatctgatacggccaccgtggaccttgaggtgacctcgggaatggagacagtgcatgggagagaatcacattggaaggggcctgggtttctgaagaccctgtaagacagatctccttgcagncctgactgcccacattagggcttttatgttagggtgaagttaccttgcattgtcatataagcaattgctatttgtggtgtcttgcaaataaacctattctgatct

SEQ ID NO: 82503 - DNA, 4887 bp, Homo sapiens
  misc_feature (4782)..(4782): n is a, c, g, or t
tggcgactgctttgggaagtcctgctggcaggcactctgcccctgggggtgtgcaaagagttgtccagttaccttgatcttctcacagcctcctccccagggcaccaggagagaccaggattggaggacggtaaagaacacacttcccagaggattcttggaggtggcttcctccaggcagtaaatctacagcccaggctccctgcatcttatggctccaatcactttggatctcatcgtcgcctgcacattgccatacacagggaaggagaagagatggagaaggcaaagactttctgaaagccgtggctaaaagctggcatgtgtcacatcagctcacattccattgtagagacggggtttcaccgtgttagccaggatggtcttgatatcctgacctcgtgatccgcccgccttggcttcccaaagtgctgggattacaggcgtgagccaccgctcccggcctggcaggcattcttgaggcaaacgggaaatgggtgaacgggaggaacattggcagcacttgtggtctgcaccaagaactgaatcgaatttccatgtgttattgaatgttcacaaagaccttgtacagcgagtgttactacctctggtcaatgattcaactcaaggctcagaaaagtcaagtgtcttgtccagggacacttagtcagaagtgaatccaaggtttaagctcaagtctgcctaactctgaatttcacagccttttgctacatatggcgaataatatatccctgagcactaaaggcagactccaaggatcttgtctctgcaatcatcattctggccataatttatgaaaagcaacccaaagtatgtgatgtaataaaaagtactatctatgagtttacccttccaaaaattgaactgaattctgagctctaaatttggaatcaaaagaacttttctctgcactaatcatttggaacatcacttaaagaaaacaacgaaaaactggtgtcccctgagagaaagcaatacaaaacattatgcataaagaaatccttccaaaaaataaaccaaatccagtcaaatctctagttttgactcctagcttaccggaaatacgtgatgggaaaaaaatgaaatgacaccactatgattcaatcagccaaatccagcatatgcaaatttctaccagataaatggtttagtttcttccccaaacaaatggcacaaggaaacggaggtaagaatgggatgctgttatagattttaaaagatttaagaaagtataaactaaatacactatgtgcatcctctctgaacgtgcttcaaacatatcaaggggtcaatgagcagttttgaaacaataagggaatttgaacactgaatggttgtcagaagatagtaagagatcattattaattttactagacataatgatgttctgattttgttttttttttaaaaaaaaaacagtgttatttcctttatagatacatcatatagtattaactaatgaaatgctttgatatctggaacgtttaaaaaatattcccgatggagtaagtgcaaagaaacaggtaagcaaaatgctgataattgctgaaacacaggatgtgtacctggggcttcatttactatctcttcattttctattttgatatttgttggacattctcataaaaaggaaagttatgttttattttctcataagctagtaatgaaatagccctacgtaactgatattgtagagacaagaataggtgtaatagagcttaaggttttcatttaaaaaactatctgtagacttcaatggatcttaggtggcatccatgcaataacactcgtggaacatgcaggacaggtgtggagctccatcttcacacagtgacattttttatgcttctgttttccctaagagtggagtgagaggatgattattttatatcatggacttcttccctgctatactttttttaattattttactttcacttctgggatacatgtgctgagcatgcaggcttgtttacataggtatacatctgccatggtggtttgctgcacctatcaacccatcatacaggttttaagccctgcatgcattaggtattcgccctaatgctctccctcgcctttccccccaccccctgatagcccccagtgagtcatattcccctccctgtgtccatgtgttctcattgttcaactcccatttatgagtgagaatatgtggtgtttagttttctgttcctgtgttagtttgctgagaatgatgttttccagcttcatccatgtccctgaaaaggacatgagctcattcttttttatggctgcatagtattccacggtgttatatgtgccacattttcttaatccagtctgtcattgatggacatttgggttgtttccaagtctttgctattgtaaatagtgctgcaataaacatatgtgtgcatgtgtctttgtagtagaatgatttataatcctttgggtatatgcccagtaatgggactgatgggtcaaatggtatttctggttctagatccttgaggaattgccacactgtcttccacaatggttgaactaatttatactcccaccaacagggtaaaagcattcctatttctccacatcctctccagcatctgttgtttccaaatgttttaatgattgccattccacctggcgtgagatggtatctcattgtggttttgattttcatttctctaatgaccagtgatgataagctttttttcatatgtttgttggccacataaatgtcttcttttgacttttatgtggaaacaaatttaactgcacagagaggtgaaaattaattaataacttttaaagtaattccctaagtttctaaggatctatatgtttccatctgactttattttatttaagctcttgattgatgctgcatttggagcaggttcatgaacatgaatagagttaatctgggacagatttccctcatttgattttttcactgtttccatcacagaacttatttcatgctcaccatgtttgcaggcattgagcttggtactggagccacagagctggatcagacagacttgtgcaaatatttcaggttttttttgtgggggggtcatatttatagataaataacagtaaagagtgacgggttcttatgaaaatgcatacacagtgaagtagagggtgaaaaggagggatgtgttctatgaggaggaagagtgataagaaagtgtaaggggatgtgtctgtgtctagacatatgtgtgttcacgtgtgtgcgtgcttgtgtgtactgcatgtgtatatgtgtggccatgcacctgtgtgcatgttcatgtgtgtgtgtgtatgtgtctgtgttgaggactaaattaattgggcttatggaagcagggagccactgataggtttaattagagactgacatgatatgatagtttaggtggatttctctgggggctgtgttgagggacagtggggaggagagctagaaggaagaaaaggacacatgcataacagaagcaatatctgtctatgggatggtggaaagaatcagaaaagacttaataaaacatgtgacactttaactgaatcttgaaatagacaagtgttggaggagggagttggaccagatacttcatgcaaagggaagaaaagtgcacaaacaaaatatgagaaacaaggcagacaggcatttttttaaaattttcgcacccactgatagaccagtgatgcattcacatcgtctgcattcatgatcaacaaaagtgctttcctagaacatgaacctcaacccaagtgtcgcctcaagtagtgtatgcatgaactcaagcattaaattagaattgattttttaaaaaactcacacaaacagatgtattatttaaaaatctttaaagcaggtttaaacagttttcaggattaaaagcagccactattagaaagaacaaaaatacatttgacataaatataaggagcctcaatagaacctcctgtacccagtcattgtcaatgccacatccattcattcaccagcccttatatcaatgcttgctgggctcacttaccacgatcagcacgtgcatgtccttatctgaaagcttgccactcaaatgtgctcagtcttacctgtgtggctgggagtgttggggatttaatgtcaagggaaagaatcttccatcaatgaatgatgaaagttagttttcacaacttccggtccccttggccctcatcaaagggctccaggtgaggtttgggctccttgctatcctccgagtttccacggtagttttaagcaccattgcccgtggtaatggctgacattgatactgcactttttttttatttaagatggagttcccctctgccacccagactggagtacagtggcgcgatcctggccatcgcaacctccgcctcccagatccctcctacaacacatgagaattgtgggtgctacaattcaagatgagatttgagtggggacaaagtcaaaccatatcattagataggacactggagaaaggcaagaaagaaaagacatctgaagaatgaagggagccaaagaaatgccaacattttgctttttgaagaaaagctaaattaaagtcaaaatggatttatcaatttccttgggttcgtgaatgtacagaactttattaagactgtcatgctgtcatcatggctggatctgatacggccaccgtggaccttgaggtgacctcgggaatggagacagtgcatgggagagaatcacattggaaggggcctgggtttctgaagaccctgtaagacagatctccttgcagncctgactgcccacattagggcttttatgttagggtgaagttaccttgcattgtcatataagcaattgctatttgtggtgtcttgcaaataaacctattctgatct

SEQ ID NO: 82504 - DNA, 373 bp, Homo sapiens
gttgtctaggaaatctttctatatacaagggcaagattttgaaatgggcaaaagagattgctggatatcatttcagtgaaatgctgaaacctccaaggattgtctgatcctgtagaggtgtctgccttcattttattctgtttttaactaggctgtttcacaatgctgacaagaagttaacctgtagaaatccaatagcaatgcaaatgattcctgtccatagaaatccaaattatgtctggtggaatgcaattgattatcaatctgtggatattaaatatgaatcagttttattagtttttgcatccattgtaaatgtttcagcatttctaataagactgagtgtgtgatactttgagtgctttttgaaata

SEQ ID NO: 82505 - DNA, 444 bp, Homo sapiens
gagagatactgtcaaaattaactgttgacagcagtaggaaatgaaagagggaggacacagaaaaatatacatgaaacctcaaacccaggtattctgggaccatctaacttagagcaaacagccctacccctcaaggatattgttgtacaatgaagtgtttaaagatgataattactattatcataatcattagaatatgacggccaggcatggtggctcatgtctataatcctagcacctggggaggccgaagcaggaggatcacttgagcttaagagttcaagaccagcctgggcaacatagtgaggacttatctctacaaaaaataacaaaaatcagccaggcatggtggtgtgtgcccatagtcctagctacttgggaggctgaagtaagccaaagttgcacaactgcactccagcctgggcaacagagtgagaccctgct

SEQ ID NO: 82506 - DNA, 801 bp, Homo sapiens
gagggagagcactttggaaaagttgccatagttttgataagctgaatgagggaaagcaaaatgctccaacggaagagaaggtaagtctgtttagctttgtggagtggtgggctttgagtagtgggctttgagtagacagtgtggctattttttatggagtttggaggtggaaatgattctcaaaactgtttcgtttttgggtgccatgctccaagtcccacccaattatttgagcagatgagttgcaaaagggcaagcagagcagcaagtgtttattccaattaagggagaaagctaaaaagcaagaattaattaagcaatcatgtcaaacaatttaaaatggaggtttttaaccagaagtcaatgtaaataccttaagcagtctgtggactttttattaataatattataagtagaattgtatgtttgtacaaaatttccagttttctagtggaagggtcacaaagttctcatgaatcaagactttaagaatgactgctgaaggaggtaggtttgatatattttggtaaggcaggaggcagcagtgtagggtgagggtggatgtgagatgttagaaaaaagtctgcacaggccagattatccagagtgaccctgagtaggaggtacccagaatcacgggattctggcatgcaaagccaagcaaaagcagtggattgccagggataactggtaaaggctctgaagaggcagcagattctgggtttggtatctgacagagatagcttgacttgtgtctgagttttaaaaaactttgaaaggtgtactgaaaggaagaagaga

SEQ ID NO: 82507 - DNA, 290 bp, Homo sapiens
aattatttcataataatgtaataaacattcatgaacataccctatcaagcaagagctagaaccttggcaatcatttccttgactcctccagtttgtggctatcatgatattcagccccaagttcatcatttctgttttttcttcgatacaggtttcttatatgtatttctaaaaatctttggttatttcatctttgtaaaaagtcattgttctatttttcccactagttctacattgcattcatattgttgtgggttgtggtaattcatttattttgactgctgtataat

SEQ ID NO: 82508 - DNA, 441 bp, Homo sapiens
cccaggaggatagccttcacgaagaacctcaccatgctggtaccttgatcttggatttccagcctccagactgtgcatcatgcacgatagaactgctgtaccccaaagcaagccataaaatctaggaagactatctgaccctctcttctcctccctgaagacccttacatgacaagtgtcatgccctatgcccagaggaagaaatgctacacagagaggccaagaaaaatctgaacacacaggacttgttggaattcccctcaagttattatcattacatcatgccttttttgtccagtcatatttctacacagctgtccattcttcatcgaacctaagcttaagaatatgcacttctccctgggtctctgggtcttcatttctgagcgctcccatgtgatgtaaaattttgattaaataaattttttcttgataaaatgt

SEQ ID NO: 82509 - DNA, 330 bp, Homo sapiens
tgtctacctccctgccattctctcaccctcatcccacagcagggtctcaggagtcccactctccctctcctctcattccagtgtcccacaactgcccagttaacccccagatgcaagccagattccatctgccccaggccccaagcttttgctttggcatcacgcgaggccaggctgctttgcaggcaccaaaattcaccctctcctactcctggaaaagcccagccccaggcctcacagagccaggggaggggatctcatcacatcacagttagaaatcatacaggcctaaagtcccagctacccaggagccaaggcaggaggatccct

SEQ ID NO: 82510 - DNA, 684 bp, Homo sapiens
agcagcggtaatctgctgtggtctttttccacggtttggaagctttatttttttgctctttgcaataaatattgttgctgctaattctttgagtccacactgcttttgtgagttgtagcactcacccgaaggtttgcagcttcactcctgaagccagtgagaccacgaacccaacgagaggaacgaagaattccagacgcgctgcattaagagctgtaacactcactgcgaaggtctgcagcttcacttttgaagccagcaagaccacgaacccatcagaaggaagaaactccaaacacatccgagcagcagaaggaacaaactccggacacgctgcctttaagaactgtgacactcagagcgagggtctgcggcatcacatttgaagtcagtgagaccaagaacccaccgattccggacgcgagcaggttgcttcagggtatagacatttggcacagtactgcagcataaacccatcaaggtaagccctgacatgttacacgaaagacaccctcacctttggaattataaagaggggacaggctcggcatggtggctcacgtctataatcccatcacgttgggaggccaaggtgggtggattatatgaagtcaggagtttgagaccagccgggccaacatataatgaaaccctgtctctacttaaaaaaaaaaaatacaaaaa

SEQ ID NO: 82511 - DNA, 373 bp, Homo sapiens
caaccattcctccctacctctaccactaccatctagtccaagccaccagtatctctcatctggattaccacaatatcctcccaaccagtctcattgttcccagctatgtctcccaccctcaccacctaatatgttctgagcacagcaattagattaattaatccagctccgttttatatcagatgacataaatctctgctctacaccctccgctggctacccatgttagagtaaaagctgaaatcctaaaaatagcccacaaggggccattatgtataaggatacagtatggtgctgtgttcccattactctctgacttcatctcctactttgttcccctttactcactgcactgacttccttgttcaatggc

SEQ ID NO: 82512 - DNA, 251 bp, Homo sapiens
tgaggttttttaaaaaacattttttaaaattattgtttttgcagaggataattttgaatttttaaaaattctaaacatgatttctgggattttgtttctttcttattttgttatttttttttattttaaatgaaattagactttttaaatagttgatggtaaacctcaaactttgaatgaatttttgtgatgttcaagagtagggtacctgcctttggtcggttcattaaagctctttattctgtttttat

SEQ ID NO: 82513 - DNA, 308 bp, Homo sapiens
catatatacataaaaatacaaacataagtgaagatttcatagctttgatataaaaattctagccatgagacaagtaaaactcgctattttaaaaggacattggattcaaagttcataaatagaacaagttcaagtttattgtatatgcctgaagcccttaccaagttttaaataacaagtagcaaatttatatttcaagcacagagaatttaagctttccaaaaggccaattcaattttacgttatctttggcaaaaatcatgttaacagaatccaaaagagtaaaacataaaggcctttcttctaca

SEQ ID NO: 82514 - DNA, 881 bp, Homo sapiens
tttttctgaaattttgctttttactatggaactatttttcaaatacagtgaaaacttgagagtctggtagtgactccatataactcatcacccagttatataacagcttttaactttttgccataatcgtttcattgtcttctctctttatgttttttcatcatcctctcaactatcctatgatttcaccctaataccaaacgctttacctactcccaggactgatatttcagcaagctggaaagaaaggaaagtacaacagggctctgggggccctggtcccaagctggagtgaagaaatgtgccctctcaaaagtatagcccctctaaaaccaaagccccaggcaagccagagataaagccttcctccaaaacagtattatggggcgttttcagaggctggcaggttagaaaacagccgctgcttgctcactacaagctgtgcttctccctactgcccagtctaagaagcagagtcctggtgttacaatgggttgcccaaagtgactgcagggtaagcttcaggatgattgttgagcaaggtgagctttctcctgtgagcaaggaattagccacagactgaacactgtgggggacctgtctttctggctcactcctcacccctcctcttttacagttgagagaaccaaggaatgcgttgggcagtattccttcttatactcatgatagccatttgacgttccaggtttatgtgtgtgtgtgggtgggtgctttcccttggactccccatctcgagtggtccttgggctttgtctcttgccccagaactcctaggctgtggcaacaatcaaagcctgagctcacttgatctagcagatgtccttttggcaaatcccagcttcggaagcctgctttaacca

SEQ ID NO: 82515 - DNA, 210 bp, Homo sapiens
cacagaattctgagtaaagttgccttttcagtcacatctgttaatgttgacaagacataatctaaaaatcaagaggatgagaatagaaggaccacttcccttctagtgacctcctggaccacaccaagcaccaacatcatgaggatccaaggaatctctggaaagttctatctccagaagataccctgagaacacttaggccctcccaga

SEQ ID NO: 82516 - DNA, 159 bp, Homo sapiens
tcttttaagaaatgtaacatgcctccaatctccatttgagaaaataatcactctaaattgaacaataaaatgctgaaagaaaattatgtaaagacagcttcatggaaaagatattaaatggttaagacaatattttctcaagatcagatcaatggataa

SEQ ID NO: 82517 - DNA, 714 bp, Homo sapiens
gcaaaccctgcctcaccacttacggtcacaagcacccacatacattgggagaataatttcagccactcatcatttgcagcatcactcttgccacaggcttctttatgtggagttcttcccttgccttcacctcacattactctctcactgtagggatcttagccctgctactgtgctgccattgccttctgatgggctgctccctggctgtattgccgtgacccagcaaattctcactcctaggcagaactcacaggagatgcctacagaggatgctgatgtaatttggtttactgatggcccctaattaaatggcaattctggaaaacactgcaaggtgatgcagctgtctctgtgactgaagtcctaaaagacaaccctctcccagaggcaaagttggcccacccagcaaaactgattgccttagccagagcctgtcgatgcgcagaaagcaaggttgctgaagtttacacagagagcagaggcgcatttacaacagcacgtgatttggggatgctccggaaataacgtagattcctgacttcttccagacaatcccttaaaaatggccaacaggcctttgatctcttggaggtcattcagaaactgaaatcactggcccttatcaaaattcctagacatcggaagccagacacttttgatggtaagagcaactgtttcacagaggctgtgaccaaaactgttgctgaagtg

SEQ ID NO: 82518 - DNA, 1250 bp, Homo sapiens
taaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggccttcgacctcactttgagaaataccttcttcaggttattctttatgtttgtcctgtggttaaatattagagtattcatgataaaacattttgagaaggggtaagcagtgagttattacccacaatttaaagcaaattttgaatgaatctttaagttaggtatctaccttcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtacctttttttttttttttactttgaagtctttaaataaaatgtataatacccattgagagtggatcatttttcata

SEQ ID NO: 82519 - DNA, 1245 bp, Homo sapiens
taaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggccttcgacctcactttgagaaataccttcttcaggttattctttatgtttgtcctgtggttaaatattagagtattcatgataaaacattttgagaaggggtaagcagtgagttattacccacaatttaaagcaaattttgaatgaatctttaagttaggtatctaccttcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttactacgacggatcaatgtgccaggagacagcacgggtccacaaggaccaatgagcaaagaatgactacagagggcagataggttatccagaagaacacaaacgcgggggccacggcaggtaaacgcgctggggagaactg

SEQ ID NO: 82520 - DNA, 635 bp, Homo sapiens
gccagttaagaactcacaggtacttttccagccacccagataggagagatcattaaaacagtgcattctgtgctacctgacacctattggctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctactggaggtgagggaccacttgggacagaggaagcaatatggtggggatttcctgagggccaggatgtcctccccagcactgacggcaggtgcttcaggaaaggtgatggacttcaacaatggcacctacctggtcagcttcactctgttctgggagggccaggtctccctgtctctgctgctcatccaccccagtgaaggggcgtcggctctctggagggcaaggaaccaaggctatgataaaattattttcaaaggcaaatttgttaatggcacctctca

SEQ ID NO: 82521 - DNA, 699 bp, Homo sapiens
  misc_feature (607)..(607): n is a, c, g, or t
tggggtgaacaacggaaatatttctaacttttgtatgaggacaattttgacaatttcattgcaagaaaaaaatatatatatagactaatttctctcattcagtagtcataaaaatacattaaaaattcagcaaattaaatccagtaatatataaaaaggataatgcataacaaccaagtctgatttacgtaaggaatccaaaataggtttaaattgggaaatcaattaatgtagttcactatattcacagaataagggggaaaactgtatcattaccaaaaaaaaaaaaaaaaaaaaaataatagcttgatccctctaaaagaaagcaagaagggaaaaaaaaaaaaaggttgtgccggtagaaaaccaattggcagatggtaaacataaacccaaatatatctgtaattacattaagtgcaagtgaaccaaaacagttcagataaaagacagtacctatttcatagcattatgactatcatgaggtaatatatgtagagattagagtacacatgtcatattaggaggtgtgcaataaatgatactttattctgaagattaacataattcatacttaaaaggatcaagaactagaatattaaaaaantagaatgtgaatgtttctgcaagttttgataagaacaagcccataaattaatctctaatttgctacatttagggaatatgggtaatgactac

SEQ ID NO: 82522 - DNA, 394 bp, Homo sapiens
ttgatatttgtgtctaattccagctactttgaaagctaaggcaaggggattactgtattaataaattctcatgctgttaataaagacataaccaagactggataattcataatgaaaaaggttaatggcctcacagtttcacatggctggggaggtctcacaattattggagcaaacaagagactttgttcaggggaatctccacttataaaaccatcagatcacgtgagacttttttgctatcatgagaacagcatgggaaaatcccacccccatgattcaattacctcccacagagtacctcccaggacatgtggagattattacaattcaagatgagatttggttggggacagagagccaaaccatatcaattacttaaggctaggagttt

SEQ ID NO: 82523 - DNA, 828 bp, Homo sapiens
atcaaatttctgatgggaatggtgaactaacatttctaaaaggtcttttgggtgaactgagtactgcaaggtttccataaccatgcttctttctagtctttttattccaatagagtacgcaaatctggacagctccttggagtttcaaggttcaaggatgaaaaatctagtttatgtgttgtatacagctaatgtcaagcctactacttcacataccatgtaacaaaaactgagctataaacaaggaaatcatacaagcaaaactacatatcagaacctaccacaatagctaaaaatcacaatgccctcaagaaagctacattaatgttggtttactaatagaacagcaaactagatagctactggagtaataatctctgaagggcaatattaccaatgccactatcacaaactataaataatcaattactagtgaatttccattatcattgcttagtgcaacaggaagtcacaaaatttagaggtgcatgataaacagaatgggaaggcactacaggtatcagtaaatagccctcctaatacctcaaacagtggaaatacactattggccctcaaaatcctaccagagtattcttttaatttaaatatatgaataaaggacacttaacaattatacaatacactagtgattatgagaggaagtgttggatagtaatactagaaaaaaattagggaaccatttcaggtacgtgcagttctgccaagggcacaaccatgtggacaaaattcatactacacatctatcgtatcaagttacttcacaagacagcaccaaatctaataattcatatggaaaatagagttgac

SEQ ID NO: 82524 - DNA, 274 bp, Homo sapiens
ggtattaattcttctttaaatgttaggttgactcaccagttaatgcagctatttggtcataaatgtttctttgttaatcactttcggttatctagctttatgtatctaggaaagggagaaagagaagctcaataaaaatgttttgtagctcttacttccccttagaacctctgagaaggaaggtggttgctgtattagtcctgcaatattgttgtattggcaggattttattttattgtggtacaatatgtaacattaaatttaccatcttaac

SEQ ID NO: 82525 - DNA, 262 bp, Homo sapiens
acaaaatacttaccattgtgttacagctgcctaaagtgttcaattcagtaacatgctgtacaggtttgtagcctaggaccaataggctgtaccataaagcctaggtaatgtgatctaggtttgtttaagtacactttgtgatgtttgcacaatgacaatatcacctaatgccacatttcttagaatatatccctgccattaagtgacatcagactatatatgctatttatacaagtcacactttaggtataaaaactgagaa

SEQ ID NO: 82526 - DNA, 283 bp, Homo sapiens
attaatatatattattatgactccttaatattatttttctaatctatattcattaggaagttaacaaatccttaatgtcttaaaaaatagtcaaatgtaaactagcaaattcaaattatctaaaattttcaacatcataacttctgaaaaatagccaacccttattgagcgcttactatgtgccaagcattggtctaagtacattgcacagactgactttttaaatcctcacagctctattgggaggtactatcattattcccattttacaaatgaagaaact

SEQ ID NO: 82527 - DNA, 490 bp, Homo sapiens
acacatagtcttgctctgtcacccaggctggagtacagtggagtgatcttggctcgctgcaacccccacctcctgggttcaagcaattctcctgccttagcctccagggtagctgggactacaggcacccaccaccacacccagctaattttctttgtattttttagtagagacagagtttcaccatgttgcccaggctggtcttgaactcctgacctcaagtgatctgcccacctctgcctcccaaagtgctaggattacaggcatgagccaccatccccgacttacatagatatgcttccttttacactgtattattttttggaacttctgtcttttgatcagttttattaaaaggtgtctattttgatagctgtgttaaaagagctgactcttggcttattgatttttttttccatctcattaatttcctctttaatttctgcagagaataacctgtctctgagggaggaaggacatagattatttc

SEQ ID NO: 82528 - DNA, 1846 bp, Homo sapiens
  misc_feature (1226)..(1226): n is a, c, g, or t
  misc_feature (1430)..(1430): n is a, c, g, or t
cacgtgctcacagagtaggctgcggcaccacgtgcagccgctctcgtgcaggcgtttgcagtgtgcagctgagttcggcagctcacacagcacccctttcaagttgttttgcagtgggtgcctcttgtgagacactgtttctgagagcagcttttgtggcatcttacagggcagatttctggtcccacccacctctgcctccgccatggctgcaagaaccgttatcattgaccacgggtctggctttttgaaggctggcacggccggctggaatgagcctcagatggtcttcccgaacatcgtgaactacctaccgtgcaaggagaaccctggccccagctatgcccgtaggcgtgtgagcctgggcatcgacatttgccatcctgacacctttagctaccccatcgagcggggccgcatcctcaactgggagggtgtgcagtacctctggtcatttgtgttggagaaccacagacgggagcaagaggtcccccctgtgatcatcacggagacacccttgagggagcctgcggaccgaaagaagatgctggagatcctgtttgagttgctgcatgtcccatcggtcctcctggccgaccagctgcagatgtccctgtatgcctctggcctcctgaccggagtggtggttgattctggctatggcctgacccgcgtgcagcctttccaccagggccgccccttgcccgccagcggcaagacgctggagttcgccggccaggatctctccgcctatctcctcaagagtctctttaaggaagattgcgatagacgctgcctgtttcagctggagacagtcgccgtgactcagatgaacaagtgctacgtgccgcagaatctgggggaggccctggactttcgtgagaggcagcagagtgccttggatgagagcaacacctatcagctcccagacggctcccgcgtggagctgacccccatgcagcgggtggctcctgagatgttctttagcccgcaggtgttcgagcagccggggcccagcatcccacgggccattgtggaatccgtggagtcctgcgagatctccctgcgccccctgctggtctcccacgtgatggcctgcgggggcaacaccctctatcccgggttcacaaagcgcctgttcagggagctgatgggggatcacgtctcctccaccaaggccacagtctgggagggttccaatagaaactttagtgtctggctaggancgtccgtgtgctcaccttctacctaccagtctgagtgatgtcccgagaggagtatggtgagcatatgaggatgtgaccctactggctcactcctgagaatgggctcctgttagatgggcacgggcggattaattttagcaaaatgttctgggtgggggtagaatgaggtggggtggggtgagctggctttggaattctaggggnatgagggtattttttaggttctaaggttttatcttgttgcaagagtgggacctacccaagggggaagacaagatgtcatccttggaaaccctgcaggggacagtttttccagggtggcctatcattggggtatgagtggctgactgccatctccatgcctgagagccactgatttttcattggcatttcccctggtttgtctcattcttcttggttgagtaggttttaactggggtagcactcctgctaggagtcccaattatttttgactaggggatgggggacagttgacatttctggtcctacaggccctttctggccagggaggcattgctgcaggtgagcctgggatgcccttgccacccgtggttggatcttgttttatatctgcaaataaatagcttgtttggaagcaa

SEQ ID NO: 82529 - DNA, 294 bp, Homo sapiens
cttagggaaggagattccacaatttatttgatgacctgtttcagtttttagcaactaggaaattcccccttcttctaacctcgattcaccgtgccacagatttggtttggacgcagacggttctgtttataggcctgccactcggctttgtctgctctcaggaatgacctccaccaggccagatcggaggtggaagccaggactcggtagctccgggaggcatgtgtcccctttctgctgggaattttctctttcttgggtaccctgtcactgagttattgtccctcccatctt

SEQ ID NO: 82530 - DNA, 436 bp, Homo sapiens
tccttactggattgagccttggttacttgccacccagaggggtgattgagttgcagtattctgttgcacctttgatgtcaacttatttttggcttaaattttttaaataacataaggttaaagaaaggatcacatctctatcttttcctcattgacctccctagttctagacaaattctatacttttttcctttctttttctctgtggtcgattatgtcattattccctccccctcaaaacctaccttctcccttggtctccgggaatactgcactctagtgattttcctcctactacggaaatgatttcattacctctctggctggtatttctttgtctttaggtcctttatgaaaacacaacctgttgccctattttctctccacttgcccttttaagatgtcctgtactcttttataattattctggtgcgtc

SEQ ID NO: 82531 - DNA, 489 bp, Homo sapiens
actgaaaaaataaattccaagaggcttagttaggtatggcagggcaaagatattttataaatattttggcaagtagagacaagagaaaatgatgcgtgaggtattttcaatagaagccaattgagcttcctcatttgcatgaagcatctgagctgttttcctaagttccagttcctcctcctcaggtgggcagccttacagcctctgcatttgactctgtcaagatgagactgtagtaaagtgagctctttgtatcattgatgaaagaaagaaaggatttaaattaaccattgggactgagttaaaataaaataaagctataaaaagatcatggctgcttgaccatgagaaaaacctagaaaatagtcatttgcatgagtcatttgttccccgagaacagcattctgttgaatggtgtccatgaggaaaatgctcaaatagataccattggttttttaaaaaattatttcatcagtaacaatgcaattt

SEQ ID NO: 82532 - DNA, 394 bp, Homo sapiens
gcaacattacctgtgacctgactcttgaaacatagctgctattaaagtacaagtgagtcatgcatagcagcttctccttgcccagttaatttctctgtaaaatctttactctcttttattcatgtatatatatgtatgtgtgtgtgtgtaaatatatacatatatatgtttgtatttccctttaaggatttcaaacacaaagaccctagtcatttgattgtctctgtactgtcgaattttgcctacaaccctgactgtagagacacattgttacctgttttccatattctgtctagtaaatgcttggttgtcaggacaacggcatagaaggtggaagctcattgataaccacgtgaattctttaaacaaatatgatcagagcaaattccagggt

SEQ ID NO: 82533 - DNA, 274 bp, Homo sapiens
cacaagaaaattacaaagtaataaagtaggctagggaagtatacataaccttaataattttactgtgggactatattaagggagtatacttaacctcataattttactaagaggatcataatctaaaccacatgtatttgatgaaagacctgacctctttgttgttcagagttggtagcatttgcatttggcctcatagatggatgagaccttgataagtaaagatgaaggaaaattattatagatgtttagcaaaacacacatgaaggtatag

SEQ ID NO: 82534 - DNA, 550 bp, Homo sapiens
tttttttgagacagcgtctcactctctcacccagaatggaatgcagtggcactatcttggctcaaaacaacctcttccacctgggttcaagcgattatcctgtctcagcctcccgagtagctgggataacaggcatgcctggctaatttttgtatcgttagtataaatgacgtttcgctatattggtctggttggtctcgaacaactgacctcaagtgatccacccatctcagcctcccaaagtaatgggattacaggcatgagctaccacacccggccttcgtttttcttttgacacagggttttgctctgtcacccaggctggagtgcagtggtgcagtcatagctcactgcagcctcaaagtcctgagttcaagcagtcctcttgcctcagcctcccaacgtgctaggatctcaggcgtgagccactgcacctagcccgaaaccaagctttctcatcccaagcgccaacctttatcaagtctagcctagtcctctattgtctcctaagtgtccctcatgagtgatcacttctgagtcctcctgcgtg

SEQ ID NO: 82535 - DNA, 373 bp, Homo sapiens
caggaaatggcaagaactcagaagtcctggtaagatgtgtgcatcaggggttggagataagccctacaaagactcagaggcctgccacatcagaaaagtttttaaaggtccagtggtatggggcatactgtggtatttcttccaagataaagaagaaatcgttaaaccttgaacatcccatctttaaggtagtggcttcatatttggtaccttaagacctggcagattccaggatgctagcaatatctgagatagatgacaatgttttgaggagtcttggtgagattaagcaggggagttacagaacaaaaccctaggattttagagcaagactgaactatttacagaaaaaaaaaaaaaaaaaaaaaaaaaa

SEQ ID NO: 82536 - DNA, 2690 bp, Homo sapiens
aaatggacaaggcatgtaaagtcactttcttttatttttatcttttttttccccccgttagaacctctggcagggactgactagcccatgaaacttatttcttcttcccgggcacacagctaaactaaatttcacagctttccttgtagttggttatagtcatgtgatgaacttctttttttgagacagagtttagctcttgttgctcaggctggaatgcaatggcacaatctcagctcaccgcaacctccgcctcccgtgttcaagcgattctcctgcctcagcctcccaagtagctgggattacaggcatgtgccatcacacccggctaattttgtatttttagtagagacacggtttctccatgttggtcaggctggtctcgaactcccgacctcaggtgattcccccacctcggctttcaaagtgctgggattacgggcgtgagccaccgagcctggccgtgattaacttctagccaattaaatatgaatggaaatgatgtgctcatttttagggttaatgaagtcctcctattctcccttactctttcttcgtcaacttgatgcctttgagcatggtgaccttcaaaactatgtattggagatgccaaagccagaaaagagaagaatgagtggctgaaacagtacttggaagacagccaccccaattagaaacacccctttttgcacttactgtaagagaaaaaattgagatttgagaatttatatgtataggagctagaatgaccatagctagtccagaaattggtacaagaagtggagtactgctaaaacaataacctaaaatatgttacatcagcttatttatgatgcagcaggtggtagagaatgtgatttggaggctagaaaaaggaggcccatgtttgcagtggcaaagtaattagtaaaactgtcacctgaaataattcaaaatcagatcacctatctgtttagattagctccagaggaaatgattgaaaagagcaaaagtaatactgtgttgaattttacattttacttttagtaaggttttactaaagagagaaactcaggaaatacttcacagaagtgagagtgtacaggaatatttctcaggaagggttggaaaagttgacttttataagacttctaataaaaaaaaaaaaaaaactagaagaggtcttgagtatagttacccttgagattaagtcctgcaacaaagatcaggaaaagggtttggtctttccattcaaagtcattattttagatggcttcaagatagctacgataaaggtctaaaggaactggcataggagcaaggcagcaaagcagtaaattaggcttgataattatgtaagaaagaactttgggtgtagttaccagaagcaaatcaatcagaagactacatttttagaggaattttattaatcatactaaatctggctcaaatatcattgttcgggtgttaaaacagagggtaactgtccaaccccaagcttgcataagtagaaaaatagagcataaaaccttaacagctccccagtacccacacaggatgtggccatggagaatgatggacaaaaaaagaacatttcagaagctcgtataaggagctgtactaaagactggacagggagtttctcctgaagactagaattggagtttcatcagaactttcttcagtttcaaggagatgggccgcaaaatgtttatgcagtatttcatcattattatacatgaatagtattgctcagtatcacattttttttctgaatgagagaatgtattatagttatctgtccctgagttaccactatatattgggtttgcagggatgggggtgacaataaagataatttgtctttttagttcttaggtcacatctgtacctaatgaagagaactgcacattttctgaaaatcctagactttgagcctgttccagtaactggttaaaactttagattgtctcctttgggacagggtatgttctgtgtgtggaaagacaggtaaaatacatgtttagtgatcagaatagtagattcttgcaaatgctaaattcttctggccacacagctatatttccatgcctctcttgcaattaggtatatgggttaggtgtgctgattaggttctaaccagtggaatgtgagaagtgatgcactcctattccagctctggcctatggaaacatcacatgagcaatccaatatatcccactccccatcaacttgaggcagatgagcaaatttgcactggaaactatgtgttaaagatggcaaagccgcaagataggactcctggtttcctgaatcttcacttggaggatacttgcttcccaattagagacacttgtgctagagtttcctgactcttcactgggaggatacttgcttgccaattagggacacttgtgctacagctcatacgcattcttttgtgttaggccactgagatttcagagcgtgccctaataaagacctgtccctctttctccagatgcaatcgttcattacctaattctaatttttataccacaggagtaggcccacaaatcaggctagccaaagtatcctatcattcagccatagtgattagttcaggaatgggcagattaacaaaactgaagttaatcagagatagtcttatcatttgggctagcactatcaagaaaaagacacctgcttctggaataagcaaaaaaaaaaaa

SEQ ID NO: 82537 - DNA, 3307 bp, Homo sapiens
ctttggaagtcctatgagggaccatttacggtttcctcagtaatttccaccaggatgaatttccttctcatcactctgcctcaggtagtgctctgaaggtcgtcctttctgaacaaacgcagcaaagcaagccacaccatgggtgagatcaaccaagttgccgtggagaaatacctggaggagaaccctcagtttgccaaggagtactttgacaggaagttgcgggtggaggtgctgggagaaatcttcaagaacagccaggtgccagtccagtccagcatgtccttctctgagctgacccaggtggaggagtcagccctgtgcttggagctgctgtggaccgtgcaggaggaggggggcaccccagagcagggggttcacagggccctgcagaggctggcccacctgctccaggctgaccgctgcagcatgttcctgtgccggtcccggaacggcatacctgaggtggcctctaggttgctggatgtcacccccacctccaagtttgaggacaacctggtgggccctgacaaagaagttgtgtttccattggacattgggatagtgggttgggctgctcacacgaagaaaactcataatgtcccagatgtgaaaaagaacagccatttttctgacttcatggacaagcaaactgggtatgtcactaagaacctgctggcaaccccgatcgtggtgggcaaggaggttcttgctgtgatcatggcagttaacaaagtaaatgcatctgaattttccaaacaggatgaagaggtcttttccaaatacctcaactttgtgtctatcatcctaaggcttcatcacaccagctacatgtacaatattgaatcccgaagaagccagatccttatgtggtcagccaataaagtatttgaagaactcacagatgttgagcgacagtttcacaaagcgctctacacggttagatcatatctgaactgtgaacgatactccattggactgctggacatgaccaaggagaaggaattctacgatgaatggccaatcaagcttggagaagtagagccttataaaggtccaaagacacctgatggcagggaagtcaacttttataaaatcattgattacattttacatggaaaagaagagatcaaagtgattccgacgcctcctgcagaccactggacactcattagtgggttgccaacatatgttgctgaaaatggatttatctgtaacatgatgaatgcccctgcggatgaatacttcacatttcagaaaggacctgtagacgaaactggttgggtcattaagaatgttttgtccctgcctattgtcaacaagaaagaagatattgtgggagtggctacattttacaacaggaaggatggaaaacctttcgatgagcatgatgaatacattaccgagactctcacacaatttcttggatggtctcttttaaatactgacacctacgataagatgaataagctagaaaacagaaaggacattgctcaggaaatgctcatgaaccaaaccaaagccactcctgaagaaattaagtccattttgaaatttcaagagaagttaaatgttgatgtaattgacgactgtgaagaaaaacaacttgttgcaattttgaaagaggacttgccagacccacgctcagcagaactgtacgaattccgcttcagtgacttcccccttacagagcacggattgattaaatgtggaatacgactgttttttgaaataaatgtggtggagaaattcaaagtacctgtagaggttcttaccagatggatgtacactgtgaggaaagggtaccgagctgtcacttaccacaattggcggcatgggttcaacgtggggcagaccatgtttactttgctgatgacaggaagattaaagaagtactacacagatctcgaagcctttgccatgcttgctgctgctttctgccatgatattgaccacagaggcaccaataatttgtaccagatgaaatccacgtctccattagcaagacttcatggttcttctattttggagaggcaccacctggagtacagtaagactctgttgcaggatgagagtttaaacatcttccagaacctaaataagcggcagtttgaaacagttattcatttgttcgaggtcgcaataatagcaactgacctggctttatatttcaagaagaggaccatgtttcaaaaaattgttgatgcctgtgaacaaatgcaaacggaagaagaagccatcaaatatgtaactgttgatccaaccaagaaagagattatcatggcaatgatgatgacggcatgtgacttgtctgctattaccaagccctgggaggtgcaaagtcaggtagcacttatggttgcaaatgaattttgggaacaaggagatctggagagaacagtgttgcagcaacaacccattcctatgatggacagaaacaaaagagatgaattacctaaacttcaagttggatttattgattttgtttgtacttttgtatataaggagttctcacggtttcacaaagaaatcacacctatgctgagtggtcttcagaataacagagtagaatggaaatcactagctgatgagtatgatgcaaagatgaaggtcattgaagaggaggcaaaaaagcaagaaggaggagccgaaaaagctgctgaagattcaggaggtggtgatgacaaaaagtccaaaacatgtttaatgttgtaatattatctaactggtctaaacttcaaatatcattttacctttgaagaaaaccagaaaacattcaaaagaacttcaacaaatcatcacgtaacaggatcttcagaaaaactaccctgtgactatgaagaaaatatatattgctagcccaaaaatcccaggggcaaaataaagttcaacaaaagtgcaaaatatgacaaaaataggtacatttttggtgccaatttattttaaattaaaaaatatgcaatcctgaaactagtcacaaattcttttttaaaacattaattgtatttatttgctaaggctgctataacaaagtaccacagactgggtgcttaaccaatagaaatgtattttctcaaagtcctgggggctggaagttcaagatcaaggagttggcagggttggtttcttgggaggcctctcaacttggtttgcagatggccatcttctccctgtgtcttcacatggtcttccctctgtgtgtctgtgtcctaatctccttttcttataaggactccagtaggactggattagggcctacccatgtgacctcattttagtcttaattacctcgttaatggccttatct

SEQ ID NO: 82538 - DNA, 1318 bp, Homo sapiens
ttaccatgttacacatattacacggtgacatgggcgcgtcgcggcccgctctgaaatttcaagagaagttaaatgttgatgtaattgacgactgtgaagaaaaacaacttgttgcaattttgaaagaggacttgccagacccacgctcagcagaactgtacgaattccgcttcagtgacttcccccttacagagcacggattgattaaatgtggaatacgactgttttttgaaataaatgtggtggagaaattcaaagtacctgtagaggttcttaccagatggatgtacactgtgaggaaagggtaccgagctgtcacttaccacaattggcggcatgggttcaacgtggggcagaccatgtttactttgctgatgacaggaagattaaagaagtactacacagatctcgaagcctttgccatgcttgctgctgctttctgccatgatattgaccacagaggcaccaataatttgtaccagatgaaatccacgtctccattagcaagacttcatggttcttctattttggagaggcaccacctggagtacagtaagactctgttgcaggatgagagtttaaacatcttccagaacctaaataagcggcagtttgaaacagttattcatttgttcgaggtcgcaataatagcaactgacctggctttatatttcaagaagaggaccatgtttcaaaaaattgttgatgcctgtgaacaaatgcaaacggaagaagaagccatcaaatatgtaactgttgatccaaccaagaaagagattatcatggcaatgatgatgacggcatgtgacttgtctgctattaccaagccctgggaggtgcaaagtcaggtagcacttatggttgcaaatgaattttgggaacaaggagatctggagagaacagtgttgcagcaacaacccattcctatgatggacagaaacaaaagagatgaattacctaaacttcaagttggatttattgattttgtttgtacttttgtatataagctgctgaagattcaggaggtggtgatgacaaaaagtccaaaacatgtttaatgttgtaatattatctaactggtctaaacttcaaatatcattttacctttgaagaaaaccagaaaacattcaaaagaacttcaacaaatcatcacgtaacaggatcttcagaaaaactaccctgtgactatgaagaaaatatatattgctagcccaaaaatcccaggggcaaaataaagttcaacaaaagtgcaaaatatgacaaaaataggtacatttttggtgccaatttattttaaattaaaaaatatgcaatcctg

SEQ ID NO: 82539 - DNA, 2816 bp, Homo sapiens
ctttggaagtcctatgagggaccatttacggtttcctcagtaatttccaccaggatgaatttccttctcatcactctgcctcaggtagtgctctgaaggtcgtcctttctgaacaaacgcagcaaagcaagccacaccatgggtgagatcaaccaagttgccgtggagaaatacctggaggagaaccctcagtttgccaaggagtactttgacaggaagttgcgggtggaggtgctgggagaaatcttcaagaacagccaggtgccagtccagtccagcatgtccttctctgagctgacccaggtggaggagtcagccctgtgcttggagctgctgtggaccgtgcaggaggaggggggcaccccagagcagggggttcacagggccctgcagaggctggcccacctgctccaggctgaccgctgcagcatgttcctgtgccggtcccggaacggcatacctgaggtggcctctaggttgctggatgtcacccccacctccaagtttgaggacaacctggtgggccctgacaaagaagttgtgtttccattggacattgggatagtgggttgggctgctcacacgaagaaaactcataatgtcccagatgtgaaaaagaacagccatttttctgacttcatggacaagcaaactgggtatgtcactaagaacctgctggcaaccccgatcgtggtgggcaaggaggttcttgctgtgatcatggcagttaacaaagtaaatgcatctgaattttccaaacaggatgaagaggtcttttccaaatacctcaactttgtgtctatcatcctaaggcttcatcacaccagctacatgtacaatattgaatcccgaagaagccagatccttatgtggtcagccaataaagtatttgaagaactcacagatgttgagcgacagtttcacaaagcgctctacacggttagatcatatctgaactgtgaacgatactccattggactgctggacatgaccaaggagaaggaattctacgatgaatggccaatcaagcttggagaagtagagccttataaaggtccaaagacacctgatggcagggaagtcaacttttataaaatcattgattacattttacatggaaaagaagagatcaaagtgattccgacgcctcctgcagaccactggacactcattagtgggttgccaacatatgttgctgaaaatggatttatctgtaacatgatgaatgcccctgcggatgaatacttcacatttcagaaaggacctgtagacgaaactggttgggtcattaagaatgttttgtccctgcctattgtcaacaagaaagaagatattgtgggagtggctacattttacaacaggaaggatggaaaacctttcgatgagcatgatgaatacattaccgagactctcacacaatttcttggatggtctcttttaaatactgacacctacgataagatgaataagctagaaaacagaaaggacattgctcaggaaatgctcatgaaccaaaccaaagccactcctgaagaaattaagtccattttgaaatttcaagagaagttaaatgttgatgtaattgacgactgtgaagaaaaacaacttgttgcaattttgaaagaggacttgccagacccacgctcagcagaactgtacgaattccgcttcagtgacttcccccttacagagcacggattgattaaatgtggaatacgactgttttttgaaataaatgtggtggagaaattcaaagtacctgtagaggttcttaccagatggatgtacactgtgaggaaagggtaccgagctgtcacttaccacaattggcggcatgggttcaacgtggggcagaccatgtttactttgctgatgacaggaagattaaagaagtactacacagatctcgaagcctttgccatgcttgctgctgctttctgccatgatattgaccacagaggcaccaataatttgtaccagatgaaatccacgtctccattagcaagacttcatggttcttctattttggagaggcaccacctggagtacagtaagactctgttgcaggatgagagtttaaacatcttccagaacctaaataagcggcagtttgaaacagttattcatttgttcgaggtcgcaataatagcaactgacctggctttatatttcaagaagaggaccatgtttcaaaaaattgttgatgcctgtgaacaaatgcaaacggaagaagaagccatcaaatatgtaactgttgatccaaccaagaaagagattatcatggcaatgatgatgacggcatgtgacttgtctgctattaccaagccctgggaggtgcaaagtcaggtagcacttatggttgcaaatgaattttgggaacaaggagatctggagagaacagtgttgcagcaacaacccattcctatgatggacagaaacaaaagagatgaattacctaaacttcaagttggatttattgattttgtttgtacttttgtatataagctgctgaagattcaggaggtggtgatgacaaaaagtccaaaacatgtttaatgttgtaatattatctaactggtctaaacttcaaatatcattttacctttgaagaaaaccagaaaacattcaaaagaacttcaacaaatcatcacgtaacaggatcttcagaaaaactaccctgtgactatgaagaaaatatatattgctagcccaaaaatcccaggggcaaaataaagttcaacaaaagtgcaaaatatgacaaaaataggtacatttttggtgccaatttattttaaattaaaaaatatgcaatcctg

SEQ ID NO: 82540 - DNA, 966 bp, Homo sapiens
cacagagcaacaagggaaagagtagtagaactgcagctttaggctgttctccaggactggtgggcaactgtggcaaggtcagcttcccccaatatttttctactttggataggaggactacctctcagcatttcctgtaatggcattgcacacctgtatacccagtctttggcaatacacattacagatactggccaaaaaagaattagaaaatcagtgtcaaagttggattgtggtccctgaagacttagattaatggaattctgctggaaacataaaggttgtttccctgctgttcacatctgttgcatcctgggaaaaaaacaaaaaggaagatgttatgtgaagagctgatgtttgcatcgccgactctccctgatttgtgctgatgatagctgaagctgcagtcttggcatcttctactgcacattgtcatcagcaaggtaagaagtgccttttgcctcctgccatgattctgaggcctccctccccagccatgtggaaccgctggagtgcagtggaagatctcagctcactgcaaactcctcctctcaggttcaagcaaattcttgtgcctcagccaccctaaaatagctgaaattacagctttggtatcagaatgatgctggcctcataaaatgagttagggaggattccctcttttgctattgattggaatggactcagctctgcaccaagcggacctaattagacatctacagaattctccaccccaaatcagcagaatatacatttttttcaggaacataacaacaacgctaattgccaaaaattggaccaacattactcgggacagggtaaaggatctccgtcaggaaatggttacaaggaagcagagatgttaaccaaagcgactcccagaacagcaggggccatacagaccgagaactcaggacaaagcacagccaactcaaaggcgcaccacacacactgggcacgcgcaat

SEQ ID NO: 82541 - DNA, 451 bp, Homo sapiens
caatatttaattttaatttttcccttataaattcacttcctatgctttatctcttttatgtttgtatgtccattcttctcttgttgactttataaaagctcttaatatgtaaaagttattgatgctttacgacctatgttctaaatatttcgctagttttatcatttattatgcagctttgtttatgcaaacatttttagcattttaatttgattattattatagagacaattctgtttattttcccttttcttggaaggaaatgcttacactttatgagtctttaaaatattactttaagtttatgatagattaaatatttgacagaaacaggccaggcacggttgcccacacctgtagtcccagcactttgagaggctgaggcaggaggatcccttgaggccacaagttcaagatcagtctggataacatgatgaaacactgtctctac

SEQ ID NO: 82542 - DNA, 225 bp, Homo sapiens
caagagattatgattttcccaaaatcagatgaaatttgtgttctttacctgctcttggatgctttacatgacacaaagttatgaaattataagtgttactatccagtcttctcattattattatctgagaatagatagtttcctttgcagaactaggtagctctcaagagaggcccagtcagcatattaaacagctggctccctgtagcagagaagctacccatg

SEQ ID NO: 82543 - DNA, 511 bp, Homo sapiens
ctagggcagggagtgggttaccttccaccgtggattaactcagttcaactgataactactcctccaggcccccagcctgggacagccctggggacacagtcacccagtagcagcactgtgcccagcacaggtaagcactcaataatgacgacggttactaagtactccacccccaccaaacagtaggcagagactgtctctcctgttggccatcataaccccagtactcagtaggcgctgaatgtttggtgaatgagtaagtgaagggaaagctgaggcaccaaccctcagggagccctcagtctggtggatgtaaccaacaaccacagaactacagaactgtatactttagatacatgaattgtgtggtatgtgaattatatctcaaagccatttgaaaaaataccaaatgtgccattaagatttggatgggaagttatgggtaatgagaatataatgacatcttgcaacattatattgagaaaaatacaaattgaaatgttttatctta

SEQ ID NO: 82544 - DNA, 453 bp, Homo sapiens
aaaccacaaacacgctctcacccacgttttacgactttataactcaccaaataaacctgattcctataaccataaaacaaagccgaaatgagttggacatgtaccagcgaggagaagcaggaggcgggtggagattgccagagggggctctcagctgtggagtcgcggctctccgtgtggatttcggcatctcagtcttgcagaaacttaatattccaatcagcacccaagcaaggcgttggaagccaaggagtgcatgagtgccccatagctgggggaatattactcaccaggtcatggtcggctgcgtaaaatacaaccctcatatatcattataactgccagccaacgacagttataattgagacggcaataactaggagagagttctttaatttaacatccaattattacaagttatcacttcttaataaatgtaatataacagacaat

SEQ ID NO: 82545 - DNA, 249 bp, Homo sapiens
ccgtataccccataaatacatatacctactatgtgcccacaaaaattaaaatcaaaaattaaaaaaaaaaacatgaaagagatcattgtggtgatgcatcagttctatatcttgcttgtaatgatggttacacaaatctacacatgacaaaatttcatagacctacatgcatacatacatacatacacacacacacgatcgtatgtaaaattggtaaaatctgagtaaggtctatggattgcaccaatg

SEQ ID NO: 82546 - DNA, 664 bp, Homo sapiens
tggtaaaaataacaatgagagcaaaggccaaaatgtatggagtatttattatgtgtcagacatttttcactaagcattctagtacaatatttcttcagatctatgaagatcttaatcttaagtagtaaatggttttattataaccactatacaaaatagaaacactaacataaaaaggttaaataatctgtttaaattatcttggattatcaacccaatcagctgtgtcctcagaacagaagctggtagcactacactgaactataccacacttgcaagccttcagaggaaaattccctaagagaaaatggtatctatgactcaatatttcttcccataccctcagtgacttacggtatttatttactaaatgccaaagcagatagtccaataggaaatacgtagctaaatggcctgcgaagagaagggaatgtcaaataacaggcaaaatagaatctgacaccctaggtctcagcaagtgttttgaatggacaataaagaaagtgactagaatgtaacctctgaaaaaatgttgtgaagcaccaatggccttgaaaaaatctagggagctgatgtaaaggacatccacttcataatgacaattattgaacaaattacttgttggagatggagttgcagacaaaacaaatatttaccactgctt

SEQ ID NO: 82547 - DNA, 553 bp, Homo sapiens
gcatcagcctcctgagtggctgggattacagcaatgcatgagagctcctgtcgctccacatcctcagcagcacgtggtgttcggtgttctggattttagacattctaatagtcagctcatgaggcacccactcatggagctttttcatccttccaatttgcttcaaatgccaaacgactgtagaatggttgacgctgagttcttcagcaacttctcatgtagctttaaaaggatcagcttcgatgactgctctcaattggttgttatcaacttctgaaggccggccactaagctcctcatcctcaaggttctcatctcctttgcaaaacttcttgaaccatcactgcacggccaatatggtgagataatggctcatggcagacaacaaacatctatgcctcgactaactgttcccgaaactactgtccattaattaatcctaaagccaaaagagggtaataatcagaaaagtattttatacctaagagctcaaaagatcagctagatgggaagaatcactgaagcactaaacagtatcatacagatttgaaag

SEQ ID NO: 82548 - DNA, 452 bp, Homo sapiens
taaggcacagaagacctttaatgacaacaattttatcatgggtgtttaaaatatactgagcagttactacatatcaggcgcctgctgaagtgatgtccttttgcagatgagaaaactgaccatcagagtggtcaaggaagtagcccaaagccacccaactagtcagcagagaccagaattccatggccagaggtctggctcctaagatcccgctctcgccccgctctatcctgttcctgctgcccctggtccctccctctattccccatcaccctatcaccttgacgacattctgggtcaggagcccaggcccccacttaagcagcggggccaggcaggtccctgtgaaggggtcagggccagagcaggtgagaagggctcctcctgtgtccaccctctcttctttttaggactctgtgcatgctgttctcttcactccctgtgcacctgac

SEQ ID NO: 82549 - DNA, 259 bp, Homo sapiens
cacaaacatacatcagcatacattcatactgtttaaaaagagaagagttttacatagaaaaggaatggaaagacagtcaacagcaatagtcaagatatctagaaataattttagaggaaaaaagtatctactactgtctttaaatacattaaaatagaacaattttacgtatttacttttctcttttaaaaaattactttaaaaatctttttagaaattaaatcactaaaaataaatttttaaagaactttaagattat

SEQ ID NO: 82550 - DNA, 316 bp, Homo sapiens
ttgcagaactaaaactgggacctaaatagcattgtttccaggagaagaaaactggttggcaatttgtcaaaatagtagaagcgaggtctcagccccgttttttttttttatggccttatgaattttaagtaacctcaggaaggcattggaagttttccttgagatagaaatctctccctctgtccttttcaaagcctccatggacaaaatactatcaaaatgatcgttattctgccagtcatgttaacaaggaagtgtgcattttaataatttttcattccttttccccagagagatagacacagggaatgccagc

SEQ ID NO: 82551 - DNA, 280 bp, Homo sapiens
gataaatgtcctcaattcccagaggacattgaggcccaaggtgatctagttggtactggcacacaggaagcccctctccacctttttggactctttgtctggtgctctcttactagttcctgccctagtccaatagcacatcctcctctgtgcttgtgcggcattcacagaggagcagatacagttgcccctggcccagggcatagagcccagggtgggaagaagcccctcgcagggacacgaggacaggtgcaaaggctgttggaggaacagtgaagag

SEQ ID NO: 82552 - DNA, 5064 bp, Homo sapiens
gctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaacagaataaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacagggccccttttaaacttgtatgtggactgctgtttggtcaaagaataccttcttagcattgcagaaaggtggtcagatgaccagtgtagtgcaggaaacagccctgtctcaactaatggaaatatatttgcatgtaacccaaaattagcttatcttgcatagaacataataagtatgtgtctttggtgacactaatgttctactatagcttattttcaaacaaggggtaaaaaaaggaaagaaagaagtgtacagaattaacatataaactttgttgtaaaactgaatcatgtcagaactgcttaaaattaacctttaccatttaatgtcatctacctgaaaacagtgagatttatactgtatcaatgtctatttttttgtttttgctatgaatataattacagtattttaatatttagttatttaatttgttctactagttggatacagaacacacaaatccagggggattaaagctggaaggggctaagagattagtttacagagaaaaggcttggtggtgggatttttttaaatgtgtgttatgtacatatatatatatatataatatatattaaaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaatttaaagaaaagttgtgttctgttttcctttctgtgtcttactccccccacactctccctcccccatcaccatcttcaattctaataaataatgctgatgttcaacagttgcagaaattgtgctattatgtaactgtgggccttgcccctgtctggccctctagatgatttgtagcagtgttattctacactttttaaaagaagcgtcctccttttgtccatgaatcatgtttaccccatacccagtggcagaggtgttctttaaagacttgaatatatgaatgtgtgtgtgtagttacttaaaggttattcctctttgtaataggaaactatatgggatgaacacttttaaactttccgacacaacttccattactaactttctaacagaacttccataactagaaggtggaaaccaaaaccctcatggtagtatttcctctggcagctggtgctgtgggcaactgttttgttcaatcgggtttcttttctttttgcctctaatgcagaaatcaacagaatcactcacacatacaagtacactcacatacataaactaattatttctctggatatctttctgtgttccatgtaaatttatttaccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatattttttgtcctgttattaacttgtaagccctagtaatggccaattatttgtacagcaacagaagtaaattgaagatactggctaagactggattgattgtggacttttatactatattgcagaaaccaatatctgtttcttggtggttatgtaaaagacctgaagaattactatctagtgtgcagtctgtgatatctgaatgttcattgtatatttgtctctgatgcaaaaaggtagagtaacacaattacaatacatgattaaatgcaatagtccaggtacttaagtaatttttttttcatttcaaataaatacctatttaccaccaaaagaaagaaaaagaaaa

SEQ ID NO: 82553 - DNA, 4773 bp, Homo sapiens
acttttgcttggggctatgcagacctcagttgcagactgggaacctatgagtcagacaaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacagggccccttttaaacttgtatgtggactgctgtttggtcaaagaataccttcttagcattgcagaaaggtggtcagatgaccagtgtagtgcaggaaacagccctgtctcaactaatggaaatatatttgcatgtaacccaaaattagcttatcttgcatagaacataataagtatgtgtctttggtgacactaatgttctactatagcttattttcaaacaaggggtaaaaaaaggaaagaaagaagtgtacagaattaacatataaactttgttgtaaaactgaatcatgtcagaactgcttaaaattaacctttaccatttaatgtcatctacctgaaaacagtgagatttatactgtatcaatgtctatttttttgtttttgctatgaatataattacagtattttaatatttagttatttaatttgttctactagttggatacagaacacacaaatccagggggattaaagctggaaggggctaagagattagtttacagagaaaaggcttggtggtgggatttttttaaatgtgtgttatgtacatatatatatatatataatatatattaaaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaatttaaagaaaagttgtgttctgttttcctttctgtgtcttactccccccacactctccctcccccatcaccatcttcaattctaataaataatgctgatgttcaacagttgcagaaattgtgctattatgtaactgtgggccttgcccctgtctggccctctagatgatttgtagcagtgttattctacactttttaaaagaagcgtcctccttttgtccatgaatcatgtttaccccatacccagtggcagaggtgttctttaaagacttgaatatatgaatgtgtgtgtgtagttacttaaaggttattcctctttgtaataggaaactatatgggatgaacacttttaaactttccgacacaacttccattactaactttctaacagaacttccataactagaaggtggaaaccaaaaccctcatggtagtatttcctctggcagctggtgctgtgggcaactgttttgttcaatcgggtttcttttctttttgcctctaatgcagaaatcaacagaatcactcacacatacaagtacactcacatacataaactaattatttctctggatatctttctgtgttccatgtaaatttatttaccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatattttttgtcctgttattaacttgtaagccctagtaatggccaattatttgtacagcaacagaagtaaattgaagatactggctaagactggattgattgtggacttttatactatattgcagaaaccaatatctgtttcttggtggttatgtaaaagacctgaagaattactatctagtgtgcagtctgtgatatctgaatgttcattgtatatttgtctctgatgcaaaaaggtagagtaacacaattacaatacatgattaaatgcaatagtccaggtacttaagtaatttttttttcatttcaaataaatacctatttaccaccaaaagaaagaaaaagaaaa

SEQ ID NO: 82554 - DNA, 5166 bp, Homo sapiens
gctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaacagaataaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacagggccccttttaaacttgtatgtggactgctgtttggtcaaagaataccttcttagcattgcagaaaggtggtcagatgaccagtgtagtgcaggaaacagccctgtctcaactaatggaaatatatttgcatgtaacccaaaattagcttatcttgcatagaacataataagtatgtgtctttggtgacactaatgttctactatagcttattttcaaacaaggggtaaaaaaaggaaagaaagaagtgtacagaattaacatataaactttgttgtaaaactgaatcatgtcagaactgcttaaaattaacctttaccatttaatgtcatctacctgaaaacagtgagatttatactgtatcaatgtctatttttttgtttttgctatgaatataattacagtattttaatatttagttatttaatttgttctactagttggatacagaacacacaaatccagggggattaaagctggaaggggctaagagattagtttacagagaaaaggcttggtggtgggatttttttaaatgtgtgttatgtacatatatatatatatataatatatattaaaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaatttaaagaaaagttgtgttctgttttcctttctgtgtcttactccccccacactctccctcccccatcaccatcttcaattctaataaataatgctgatgttcaacagttgcagaaattgtgctattatgtaactgtgggccttgcccctgtctggccctctagatgatttgtagcagtgttattctacactttttaaaagaagcgtcctccttttgtccatgaatcatgtttaccccatacccagtggcagaggtgttctttaaagacttgaatatatgaatgtgtgtgtgtagttacttaaaggttattcctctttgtaataggaaactatatgggatgaacacttttaaactttccgacacaacttccattactaactttctaacagaacttccataactagaaggtggaaaccaaaaccctcatggtagtatttcctctggcagctggtgctgtgggcaactgttttgttcaatcgggtttcttttctttttgcctctaatgcagaaatcaacagaatcactcacacatacaagtacactcacatacataaactaattatttctctggatatctttctgtgttccatgtaaatttatttaccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatattttttgtcctgttattaacttgtaagccctagtaatggccaattatttgtacagcaacagaagtaaattgaagatactggcttaaaaaaaaaaaaaaaaaaaaaaaaaaaaagtgtgtgtggggggcccggggccctgtggaaagagtttttggagaacacattgggtggggggggggggccccagagggttagggtgcacaggtggcacacaagggtggttccctagaggaagaaccggggggcacaggagcaaactgagacgggatggcgaattactacacgccataatgaaaaaaaaccgcacgggggggaaaacacggagagggcttgtggaaacaagactcccgaaagaggaagctccaggagggcacaagaaagggggaaccacaaacacacgggggtccacacgacgaaaccgaataatacaatataccccgcgcgacgg

SEQ ID NO: 82555 - DNA, 2302 bp, Homo sapiens
gctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaacagaataaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatcccc

SEQ ID NO: 82556 - DNA, 850 bp, Homo sapiens
gctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaacagaataaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggggaattctgagttgatgagtataaaaaggcctctgcaggtagcccaagagacgataactaaagtccagaggtataaacagaaagaggaacagacactgtagatttttcttaactccatgacttcttcttgcagaaattctgcattaggcactgttt

SEQ ID NO: 82557 - DNA, 208 bp, Homo sapiens
aatagcttccctggtttaatactgcttttcttcatagactgaaacaaataatacagctttccttttagtccttgttcagccacacaacacaaaccagtatggcctttggcattttactgcaagctttccattcgattattaatgtttccggtgcccatgatcaagcatggagaagacctataattaattgacttttcctttcctttag

SEQ ID NO: 82558 - DNA, 352 bp, Homo sapiens
agaaataggaaagctggaggaaagtcctgcagaggccctgttaggttgaacattccacccagcaggtcttgtaggagattcaaaagcccagctctatttcagagatcattttttctcaacgtaggtatcaggatgcttgatttatatgaatatttgaaattatcatgctctatgagataatgacattagtttttcctgttcctgtcctaataccatgatttcttttttctagaactcaaagaacctgtaggacaaatcgtatgtacagataaaggtattcttgcggtggaacagaataaggttcttatcccaccaacctggaataaaacttttgcttggggctatgcagacc

SEQ ID NO: 82559 - DNA, 1914 bp, Homo sapiens
  misc_feature (4)..(4): n is a, c, g, or t
  misc_feature (7)..(7): n is a, c, g, or t
ggcnggngtgtagtggtgcaatctcggcttactgaaacctctgcctcccaggttcaagcaattctcctgcctcagcctcccaagtagctggaattacaagcatgcactgctatgcccggctaatttttgtacttctagtagagacagggtttcaccatgttgacctggctggtctcaaactcctgacctcaaatgatccgcccatcttggcttcccaaagtgctgggattataggcagcactacacctggcctgaaccatgtttttaaactaatatgactataatctttttccctgtactttgaaacagccattgtgtgcaggcagcccgctgccacatcttccaagatacgggaaatctaactgtataacatgatggaaattaagttatctgttaaccctgacagtctctcttcattgagtaatgtaaattggttccttaatctgtttcttaactttttaatttttgtacttatttaaatttagttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatcccc

SEQ ID NO: 82560 - DNA, 4676 bp, Homo sapiens
  misc_feature (4)..(4): n is a, c, g, or t
  misc_feature (7)..(7): n is a, c, g, or t
ggcnggngtgtagtggtgcaatctcggcttactgaaacctctgcctcccaggttcaagcaattctcctgcctcagcctcccaagtagctggaattacaagcatgcactgctatgcccggctaatttttgtacttctagtagagacagggtttcaccatgttgacctggctggtctcaaactcctgacctcaaatgatccgcccatcttggcttcccaaagtgctgggattataggcagcactacacctggcctgaaccatgtttttaaactaatatgactataatctttttccctgtactttgaaacagccattgtgtgcaggcagcccgctgccacatcttccaagatacgggaaatctaactgtataacatgatggaaattaagttatctgttaaccctgacagtctctcttcattgagtaatgtaaattggttccttaatctgtttcttaactttttaatttttgtacttatttaaatttagttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacagggccccttttaaacttgtatgtggactgctgtttggtcaaagaataccttcttagcattgcagaaaggtggtcagatgaccagtgtagtgcaggaaacagccctgtctcaactaatggaaatatatttgcatgtaacccaaaattagcttatcttgcatagaacataataagtatgtgtctttggtgacactaatgttctactatagcttattttcaaacaaggggtaaaaaaaggaaagaaagaagtgtacagaattaacatataaactttgttgtaaaactgaatcatgtcagaactgcttaaaattaacctttaccatttaatgtcatctacctgaaaacagtgagatttatactgtatcaatgtctatttttttgtttttgctatgaatataattacagtattttaatatttagttatttaatttgttctactagttggatacagaacacacaaatccagggggattaaagctggaaggggctaagagattagtttacagagaaaaggcttggtggtgggatttttttaaatgtgtgttatgtacatatatatatatatataatatatattaaaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaatttaaagaaaagttgtgttctgttttcctttctgtgtcttactccccccacactctccctcccccatcaccatcttcaattctaataaataatgctgatgttcaacagttgcagaaattgtgctattatgtaactgtgggccttgcccctgtctggccctctagatgatttgtagcagtgttattctacactttttaaaagaagcgtcctccttttgtccatgaatcatgtttaccccatacccagtggcagaggtgttctttaaagacttgaatatatgaatgtgtgtgtgtagttacttaaaggttattcctctttgtaataggaaactatatgggatgaacacttttaaactttccgacacaacttccattactaactttctaacagaacttccataactagaaggtggaaaccaaaaccctcatggtagtatttcctctggcagctggtgctgtgggcaactgttttgttcaatcgggtttcttttctttttgcctctaatgcagaaatcaacagaatcactcacacatacaagtacactcacatacataaactaattatttctctggatatctttctgtgttccatgtaaatttatttaccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatattttttgtcctgttattaacttgtaagccctagtaatggccaattatttgtacagcaacagaagtaaattgaagatactggctaagactggattgattgtggacttttatactatattgcagaaaccaatatctgtttcttggtggttatgtaaaagacctgaagaattactatctagtgtgcagtctgtgatatctgaatgttcattgtatatttgtctctgatgcaaaaaggtagagtaacacaattacaatacatgattaaatgcaatagtccaggtacttaagtaatttttttttcatttcaaataaatacctatttaccaccaaaagaaagaaaaagaaaa

SEQ ID NO: 82561 - DNA, 3665 bp, Homo sapiens
gctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaacagaataaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacagggccccttttaaacttgtatgtggactgctgtttggtcaaagaataccttcttagcattgcagaaaggtggtcagatgaccagtgtagtgcaggaaacagccctgtctcaactaatggaaatatatttgcatgtaacccaaaattagcttatcttgcatagaacataataagtatgtgtctttggtgacactaatgttctactatagcttattttcaaacaaggggtaaaaaaaggaaagaaagaagtgtacagaattaacatataaactttgttgtaaaactgaatcatgtcagaactgcttaaaattaacctttaccatttaatgtcatctacctgaaaacagtgagatttatactgtatcaatgtctatttttttgtttttgctatgaatataattacagtattttaatatttagttatttaatttgttctactagttggatacagaacacacaaatccagggggattaaagctggaaggggctaagagattagtttacagagaaaaggcttggtggtgggatttttttaaatgtgtgttatgtacatatatatatatatataatatatattaaaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaattta

SEQ ID NO: 82562 - DNA, 870 bp, Homo sapiens
gctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaacagaataaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagctgtttcctggggatcctctgaacgc

SEQ ID NO: 82563 - DNA, 841 bp, Homo sapiens
cccagcacttggctccggtggtgacagccggatgctcctgttgccttgcgtcatcagcaggtaatctggggaggttcactggtaccttgtgaatattctgtttcctgtcagcctttcacctaatggtcttagcatccctaaatcattatttcatcagggatgtcaaagatgatttccatattctgtgattcttttcacatgtattagcgggcattctgtaaagaaacttcttatcatcaataagagaacatcatagattcttctaaaaaagcagggtcaatgtttcattctgtcctttatccatttgaaaggaagatagtcacctatagttgtggaaatcagtgttttcctttcactcctctgcttctttccctccatccttcctttgtgaatcactgtgtgccaactgactattcattgtgttgtagtcacagtcatggggttttctgctgctcacttgatttcagatatggccagtggaaactcctgctggctggttcctgtgtccttttcatatgtgtgtattaatgtttaagagccaaaatccaggctgggtgcagtggctcacatctgtaatcccagcacttcgggaggctgaagtgggtgaatctcttgagcctaggagttcaagaccaatttggcaactgtggtgaaaccccatctctacaagaaataccaaaaaataaaaaagagaaattagccaggtggggtggcacacacttgtggtcctactcaggaggctgaggtgggaggattgcttgagcctgggaggcagaggttgtagtgagcagagatcataccattgctttcaagcttgagtaacagagcaagacttttgctt

SEQ ID NO: 82564 - DNA, 718 bp, Homo sapiens
cccagcacttggctccggtggtgacagccggatgctcctgttgccttgcgtcatcagcaggtaatctggggaggttcactggtaccttgtgaatattctgtttcctgtcagcctttcacctaatggtcttagcatccctaaatcattatttcatcagggatgtcaaagatgatttccatattctgtgattcttttcacatgtattagcgggcattctgtaaagaaacttcttatcatcaataagagaacatcatagattcttctaaaaaagcagggtcaatgtttcattctgtcctttatccatttgaaaggaagatagtcacctatagttgtggaaatcagtgttttcctttcactcctctgcttctttccctccatccttcctttgtgaatcactgtgtgccaactgactattcattgtgttgtagtcacagtcatggggttttctgctgctcacttgatttcagatatggccagtggaaactcctgctggctggttcctgtgtccttttcatatgtgtgtattaatgtttaagagccaaaatccactgcaccctgccgagactcatttcttaccaggctttgaaccatgttataggccagcagttgtacagagtcaccaatattctgaacctgcgtatttttttacggtgttatttctgtatatttcctataaactggaagttaggtgtaagaccttctttagatcaggtggtgt

SEQ ID NO: 82565 - DNA, 1261 bp, Homo sapiens
ctaggacatgctagatattcaaagcttgttgaataaatgactgaaaggatgcagaattttcaaaattccctcttcaagtacttcttctacaggaatgggtagagtgggaagtgaggagacagggtgggtatgtgggtgggaatagggcaagtgacttaagctggtgtgggtgggctccagtatccacttctacttcaatcagagcaactcaacaatgctacatatataagcccactatgaaaattggatattgaatcagctgggaaaatgaattccttactgagcatttcaacttaaacttgggttccaagtggattaaacagatgatgttgtaacactgttatcagcctgacaggaaatgcatagagacaccagtcctcgtttcttaaagtggaggagcctcagctagcaaattgccacttattagcttgtctcacctataaaagagccatggaagagaagtgcaagagaactgaagtgatttcctgatgacagcagggggtgctctcactagactgaaggacagatacattctcagagcagtaggaaaggaataacacattgccttactacgactctatatgagactttagaagtgcctaatacctgcctggagcaaaagaattaatatgctctattccacggctctgccgtcttcaactttgataaatacttaaaaatgtatttttgaaaagtcattaacttctggaatataggattcagccaccacacttagaatgtgtgaaactgtggtgcaatttgtaacaggatgtacaccacatttttaatcagggaattgtgttttttaaagctaagagacctgtagtgaattaaggcatttggctcagccaaacattccaatcacgaaacgatcgaagaggaaatctatagaatcttattataaacttacaaaaaggataactgtgggtctcggccataaactgaagtaatacagatgaactggacacatatgttgcacaataggtgattcagagcaatatagcctatgctgttttatgatatggaaagcaatcaaatcttatttgcaaaaaattcagatcaattgaattttaatgagaagcaggtgctggagtgtagcatccacaaagaattctgggaatgtttaaaattagtcccatatttgccaggagacagttgggtacataaacttttttatttcttgattcatgggtctattcggactgtagattgctctgccattctgagttcagcaatttgaataaattatgctgaaaatcac

SEQ ID NO: 82566 - DNA, 727 bp, Homo sapiens
ctaggacatgctagatattcaaagcttgttgaataaatgactgaaaggatgcagaattttcaaaattccctcttcaagtacttcttctacaggaatgggtagagtgggaagtgaggagacagggtgggtatgtgggtgggaatagggcaagtgacttaagctggtgtgggtgggctccagtatccacttctacttcaatcagagcaactcaacaatgctacatatataaggtatgtattggggtgttagtatacattttcatattaaaaacaatgagttttaaaactgatggatcacttattttaataaagaaaaatgggtagggcttggaaaaaagaaagaccacttagtttaaactctatgaaactcagtttccttttttatatcatagagttattatgaggatgaaatgaaataatgtatggaaagtgcctggctcatggtatgaaacttcaccttccttgtaccaacccactgcttttgccagcagagccaggactaaggtgaggcaagtgagtgctaggggcacaaagtttaaggggataatcattttcaaggtcatgcacttgacctacaagtcatgacacactggccaaactagacttcaaacctttttcaaacacattgcttattcttttcaccaagactatcctccctgccaattaaacctaaggaaagcctacctagaatacaaccctttcttaataaaagcttctgcagtcatcca

SEQ ID NO: 82567 - DNA, 587 bp, Homo sapiens
ctagttataaaagtataggttaatttaagaaaagctgagggttttaaaagaatatttagttttatgcatagaaaaaaggtataaaagtaaaaacctgctgctcatttgggtattaaaggtataagtgttaagtataaatgttatattttctaattggctagtaatttatgtacttttatttacatctttttgtgtattaatttttcccaaaacatactgaaagtttttgttttaatacttttctattgatcttcacaattttcaacttcttcaatccaaatttatcgattagtaatgatgttgcttttttctttttaaagtttttacctattatgttttctgccatattaatcagtattttaaaaaattactaatggctgtaataggagacacacacaatttgttaatgagaatgcatcaagtttctcaccattaagcataatgtttatctgtcttcatacagccatatatgttttatatatgtgtgcacgtgttcccttgtgtacgtgggttgcatatgtgtgtgtagttattatgttaagacataccatatcctttattaaactcattgaaattaagaaatgtta

SEQ ID NO: 82568 - DNA, 496 bp, Homo sapiens
catctgatttgtgtgggcaatcttatataattatacatgtcagcctcactaaagtaattcaggacacatttttcaagtgtcatttatgcacatggggctgtgattctgttctaggaaggccctgcttaacctggctgttgcccttctctccaatctcattttaacctctctgcctggctacatatggccctcctttctggttcttgaacaccccaggattgtccatgctcagagcctttgaatttggtgttcactgtgcctggaaagtgcttcgtttggctttttgcatttatccaaaaggcttcagtttaaatgtcatctcttctttaaccatagaatacacatcatttactccctctcacattatcctcttatcttgtgtcacctactacaatctgtaactatcttaatagggactaggtctgcctttttcatgcctaaactcccagcacctagaacagaatctgacatgcaatgggctttcaataaatatttg

SEQ ID NO: 82569 - DNA, 692 bp, Homo sapiens
aggtgagcttgtcagcgggcacacgtatcctatgatctgaacccttaaattaatgaacagatgggtgtagacagcggtttgcagcccctgttgatgttgggttggtttataatcaccatatggaacagaatcggagcctcgcgtccacttcgatgctagaattctgttcgagtgctgatgaccaggggcggctaaacaccatgccctgccatctctgggtcttagagtcaccctaacatctgatctagattaattatcatcatgtgcgaggttttggcatgaagcacgccaggctcaccgtttcatgatcttagactatttacagcaaactcaaacagctcacttgctttttacaccctgcaaaagaccaagggagagcctggaggggttgttttttttttctgttttattctatcaaagcagcaaatactgcaatttccacagtaaatggtcacagtggggaccaatatcctgccctccagacccgctgcttcagccaatacagcaagggaagacgcagctctgttttctagaaggatcccaccgaggcataaaaacggcgcagcccagcctggcgccgcgccgggtcccggagccccgggcgcgaacatggggaatgcgcactccaaaagcggggacaggcacagcgcgctccccggccgccccgagctgtctttttacggctctttccc

SEQ ID NO: 82570 - DNA, 450 bp, Homo sapiens
accattgccagggccctggtcagaaccactatcatctcccacctggaggttgccacagcatggcctccctgcttctacccaaatcttcccacaatctttctcaactcagctgccatgggatgcttttaaatcagtagacagttcgtgtcacctctctgctcagaacccttccgcatctcccatctcagacagaataaaaaccaaagccccagcaatagcctcccagggcttacacaatctgtactgatctgagtccaacaactccctggcctccttccctacttctctccctctctctactccacagacctctttcctgagcttcagacacaccacggagttccctcttagcatctttattctgttgtttctgcctacaatgctcttccctcagtactttggccagctccttcccctccttcaagtctttgctcaattttcacttaggag

SEQ ID NO: 82571 - DNA, 1007 bp, Homo sapiens
tcacgccaatttagggtctccggtatctcccgctgagctgctctgttcccggcttagaggaccaggagaagggggagctggaggctggagcctgtaacaccgtggctcgtctcactctggatggtggtggcaacagagatggcagcgcagctggagtgttaggagggcggcctgagcggtaggagtggggctggagcagtaagatggcggccagagcggtttttctggcattgtctgcccagctgctccaagccaggctgatgaaggaggagtcccctgtggtgagctggaggttggagcctgaagacggcacagctctgtgcttcatcttctgaggttgtggcagccacggtgatggagacggcagctcaacaggagcaataggaggagatggagtttcactgtgtcagccaggatggtctcgatctcctgacctcgtgatccgcccgccttggccttccaaagtgccgagattacagcgatgtgcattttgtaagcactttggagccactatcaaatgctgtgaagagaaatgtacccagatgtatcattatccttgtgctgcaggagccggctcctttcaggatttcagtcacatcttcctgctttgtccagaacacattgaccaagctcctgaaagatgtaagtttactacgcatagacttttaaacttcaaccaatgtatttactgaaaataacaaatgttgtaaattccctgagtgttattctacttgtattaaaaggtaataatacataatcattaaaatctgagggatcattgccagagattgttggggagggaaatgttatcaacggtttcattgaaattaaatccaaaaagttatttcctcagaaaaatcaaataaagtttgcatgttttttattcttaaaacattttaaaaaccactgtagaatgatgtaaatagggactgtgcagtatttctgacatatactataaaattattaaaaagtcaatcagtattcaacatcttttacactaaaaagcc

SEQ ID NO: 82572 - DNA, 1027 bp, Homo sapiens
tcacgccaatttagggtctccggtatctcccgctgagctgctctgttcccggcttagaggaccaggagaagggggagctggaggctggagcctgtaacaccgtggctcgtctcactctggatggtggtggcaacagagatggcagcgcagctggagtgttaggagggcggcctgagcggtaggagtggggctggagcagtaagatggcggccagagcggtttttctggcattgtctgcccagctgctccaagccaggctgatgaaggaggagtcccctgtggtgagctggaggttggagcctgaagacggcacagctctgtgcttcatcttctgaggttgtggcagccacggtgatggagacggcagctcaacaggagcaataggagggtaaccgtggaggccacgtgagatggagtttcactgtgtcagccaggatggtctcgatctcctgacctcgtgatccgcccgccttggccttccaaagtgccgagattacagcgatgtgcattttgtaagcactttggagccactatcaaatgctgtgaagagaaatgtacccagatgtatcattatccttgtgctgcaggagccggctcctttcaggatttcagtcacatcttcctgctttgtccagaacacattgaccaagctcctgaaagatgtaagtttactacgcatagacttttaaacttcaaccaatgtatttactgaaaataacaaatgttgtaaattccctgagtgttattctacttgtattaaaaggtaataatacataatcattaaaatctgagggatcattgccagagattgttggggagggaaatgttatcaacggtttcattgaaattaaatccaaaaagttatttcctcagaaaaatcaaataaagtttgcatgttttttattcttaaaacattttaaaaaccactgtagaatgatgtaaatagggactgtgcagtatttctgacatatactataaaattattaaaaagtcaatcagtattcaacatcttttacactaaaaagcc

SEQ ID NO: 82573 - DNA, 423 bp, Homo sapiens
tcatcttgcatttgtggagactggattttacaccttgttaaagtgggtccttttagtttttccttttgttgtttgctgatttgttttaaatcacaatttattgatttcttacaatcaaatactgccaactagcattacttccactcatgcatcattaaaagcaaaggatatttcctccttggtatttttaaatggtacattatacaataaacaaagttagaacttaaaatgcacccttattaattatgtaaactggtaatttgtttaaaaaagcataactaataatttggttcctttcttcataaaatggaaatttaaatatttctcctgatagtcttgaggtgatcattagtagtgcaaagtgtggcacacacgtatagtttcatctagaaaggtgtgtctcttacacaacttatttaaaca

SEQ ID NO: 82574 - DNA, 686 bp, Homo sapiens
caacacggggcctcccctggtggaatctccacccactatgcatgtccctccttgctccccagtgggagggcaccctgggagcacagcagaacctgggggaggggagggggagccctgagaaggctggcttagccgtcttgggagtgactgtacagctgtgtgcaggtgtgtgcggaacacaggtccagcgatccgggagaaggagctgaaggcagagtggtcctggaggatgcgggtgaggtgagcaaatgggcctccccccacagacttggggccccaccctgcagccaccctagccctggaagcccctcaggttgctcgtttctgccatcaagcctggctcctcctggagcctcacgcacagagtctgatctgcactgggagctcagaaggcaggcatgaggagcctgctcccatctgcgggggtggagaccccggaatcgacacccaaaggctgctgggagcacatgagggggtgggagaggaaggcaggaagaggagccctgagggcggctctgaggctggggtgggtaccctctgccacctccacctccaccaggccaccgtgctgcctgaagctggccccggaaaggtgcttgtgcatgggcacagaggtgtgcacacacacacggggctgcaggggcaggaggaggaaggagccccagcccagactcagcccagccctg

SEQ ID NO: 82575 - DNA, 709 bp, Homo sapiens
gcgtcttctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaagagatgaggtctcactatgttgcccagactgggattctctggcttttaatgaacaattgcttcttaaatctttccccacggaaaccttgagtgactgaaatatcaaatggcgagagaccgtttagttcctatcatctgtggcatgtgaaaagcaatcacagtgttaaaagaaggcacgttgaaatgatgcaggctgctcctatgttggaaatttgttcattaaaattctcccaataaagctttacagccttctgcaaagaa

SEQ ID NO: 82576 - DNA, 812 bp, Homo sapiens
gcgtcttctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaagtcttgtgaatcttttgtcaattttatttctagctatttgatgctgtgaaatgtttcattctttgcaattttgtattctatctccttgagctgtgtgtagaggcataattctcatgtattgattttctatccagcaaccttgttaaatatgcttatgaattttaaaagtttacttctaggttttttcagttttcaacctacagaatcatatcatttttgaataagaacaattttgtttctgccttt

SEQ ID NO: 82577 - DNA, 955 bp, Homo sapiens
gcgtcttctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaagagatgaggtctcactatgttgcccagactgggattctctggcttttaatgaacaattgcttcttaaatctttccccacggaaaccttgagtgactgaaatatcaaatggcgagagaccgtttagttcctatcatctgtggcatgtgaaaagcaatcacagtgttaaaagaaggcacgttgaaatgatgcaggctgctcctatgttggaaatttgttcattaaaattctcccaataaagctttacagccttctgcaaagaagtcttgtgaatcttttgtcaattttatttctagctatttgatgctgtgaaatgtttcattctttgcaattttgtattctatctccttgagctgtgtgtagaggcataattctcatgtattgattttctatccagcaaccttgttaaatatgcttatgaattttaaaagtttacttctaggttttttcagttttcaacctacagaatcatatcatttttgaataagaacaattttgtttctgccttt

SEQ ID NO: 82578 - DNA, 566 bp, Homo sapiens
gcgtcttctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaa

SEQ ID NO: 82579 - DNA, 1029 bp, Homo sapiens
  misc_feature (734)..(734): n is a, c, g, or t
  misc_feature (1029)..(1029): n is a, c, g, or t
ctcatatttcacacagatgagttggcgaggaagatcgacctattattggtctaggccaataataggtcgatcttcctcgccaactcatatttcacacagatgaatctcagtagaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaaaaaaaacaaaagaaacaaaaaaaaaaacagtctttgttgcggcgcggcgctgggcccttgagaaaagtcgtttctctagaacccagtcccgtgtttggcgcggcggcgggcgccgcatgatggtgtactctgcagaccaccttgcgggctcaaacggcgtgtgttcctcagagggagaaacccnccgtgggtccatacgagacaaaaactcgcgttgtgggtgttctctcccccccagcatatatgaaaaaaaaacgcgccgcgtcggggtgagaaacccccgagaggggtggtttttgagagcaccaaatcttccccataaaagtgggagcactcctccaggaaggggggaccatacactggcggcgctcgtccatcctccaccagcagcggaggtggtcccccaaagagcagagagctcttgccgagattttccaaaatatatgcacgccccggtgctctcggctcgtggtggggtn

SEQ ID NO: 82580 - DNA, 680 bp, Homo sapiens
gcatagtggaaacagtacaggttctctaaaaagtgaaagaccctggtttaaatccagcggcgccatttggaattggtgttacccagggttttcttttactatttctacaccttagtttttaatgttctacgggggaaaccattcacttacatttacacaacgttattgagtatttaccatatggcaggcactgagatgagattctaggaactaaggtgtgaataaaacagatgaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagaggggggggcgcggcgctagccagaaagactatcctcgcacaggagggagcgagcgcaacagaaaccgacgcgcgcgcagcagctaattatctagagaaaaaaggggcgcgactactaaagagaggagggcgtatatttataaatacgaggagcggcgcggcagccggcggccgtatctaaaaaaagagctggagtgagagaagaacaacacgagaccatgcgggagggacaaccacttataggagaaacgaccccctcatcactggcggggggggagcgacaaaaagtgggggcgaagaaaacccaccagaaaagaaaataaaaacaccccgagggagaaagaaaac

SEQ ID NO: 82581 - DNA, 745 bp, Homo sapiens
gcgatcgaggaggaggctgtgtgtgtgttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggtaggtatataatcttcttggttataataaattcaagttttagctggcctggccttctgtgtg

SEQ ID NO: 82582 - DNA, 7235 bp, Homo sapiens
gcgatcgaggaggaggctgtgtgtgtgttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgccttttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggagatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttccaaaaaaaaa

SEQ ID NO: 82583 - DNA, 370 bp, Homo sapiens
aaattttatttatctttggtaataatgttaataataggattgatacagacattcaataacatagatattctaccaggtttgcaaggtaaccaaaactatcgtgttttctgaatagtaacaaattgtatatttagcttgaattttactgttatcatagcaagttttatgtctgtactgtttacagcctgtatcccaaccagttggagctgaacaacaagcagctcttctaaaaccagatttagttcgaaggtaagtatcttcaaattaataccatgagaacaatgaggatatgctgaagtttgtttactcattaggtgcttagtgcatcctgactagagaagcttctgtattcttgtacttgtgtggatgt

SEQ ID NO: 82584 - DNA, 7288 bp, Homo sapiens
gcgatcgaggaggaggctgtgtgtgtgttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgccttttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggaaaaaacagaattgtaacagttccttgattctgcagatactgctgctgttttacgatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttccaaaaaaaaa

SEQ ID NO: 82585 - DNA, 462 bp, Homo sapiens
ctcccaccaggccccacctccagtattgtggatctcaacatgagatttcagtggggaaacatccaaactatatcatctgggtaactttctaataaactatgtatgtgatgtcaaatgtaattaccatatgtaattttaaattttaaaagccttttacttaacttttatgcactggaattgtgttttaaacctaacaggaagccgttatcattagaatgatcaaaacctgataatagtaaacaaaagagaaagttaatttatgggaataatcattcgggcaatagaataaccagcatatattgctgtcttaaaggggagtagctgtcaacatgtgttactaatagttaaaggtttccagaaaattttcagtatctccctgccaatcaataaagatagcatcacactcatcaccatagctttagttgtcagaaatggtgtatttattgactaaatgcagcactt

SEQ ID NO: 82586 - DNA, 326 bp, Homo sapiens
  misc_feature (121)..(121): n is a, c, g, or t
  misc_feature (168)..(168): n is a, c, g, or t
  misc_feature (225)..(225): n is a, c, g, or t
ctcccaccaggccccacctccagtattgtggatctcaacatgagatttcagtggggaaacatccaaactatatcatctgggtaactttctaataaactatgtatgtgatgtcaaatgtaangaatgatagataatagtgaacatgaaggaaaatgatagatgcatcgncctgtgatattccttaaattgtgtgagcttgtagatttcagagtaatagacatattnaatacaagttataaggactaatcacttcataatgccagtttataaggaaaaatgtttatgtgatgaatttataccactgagcttaaacataatatcttaac

SEQ ID NO: 82587 - DNA, 458 bp, Homo sapiens
aaacactcctggcacataaaattacgtaacagtttaccatcatcagtaagccctgcaattgagataccaatatgtttgtcaatatggagaatttttttctgatgagctgcaagctccgatggtgcccttttcaatgcaaccaatactgcatgggtttttgatttcagaccaactgtggctgaaccttgtttaacagcttccattgcatattcagtttgatgaatcctgctccagacaatgatatcattgtcatactggtttctaaatgtggttccagcacaggtctggttgcagcctctggcaaaactgaggatcaagaagttgctgcctaaactattactctgcgttgtacagagaagtctgtgggactttgcaacccagacttttcagcactgtctttaatttgatcacaaggtttacaaaataggagagtgatcaatattagtggaaagtggatt

SEQ ID NO: 82588 - DNA, 415 bp, Homo sapiens
tcataaaaacatctcatcagttatttaatctcatgtaattaatttttgttctgcttgatcttgataagtagtttcacaaattcatctgtttccttattagagttctgaagaattttcagttagtctgtcgatcttaaagttattagaaacctgtatttaagagtgcttcttagagtcttttccatgaatctgattgcaaatgcttttagagaaaaatcaaaacaataacaatggataaggaaaacagaatagctatggtttaaaatctggtggaagttcattataattagcaattgacaaggaaatctggctatttctgtagcatacaacataataactagagttatggcatattaggtttctgagagttttatacaattttggaacattcctataaaaacacacccataaatgt

SEQ ID NO: 82589 - DNA, 532 bp, Homo sapiens
aggctcgggcaagcacgaacatcatatttcagttcagttggatgtatcaatcattagatctatttctagaacttaaaggtgctccaatccaagagcagcatgtcacctcaaaagcaaagcaccacaaattacagcaatagtaggaaacatatttgaatacactgattaatgtcaatgtgttcactgtagtttttccaatctatacttcactaaatgtgcatatttgaaagccctgagggactatgattaccccaaaaccctggtgttgttaaagtatttgatgtcagaaaaaattaaattcctaggattcctatattcaaattattatgtaactgtttgaaaacattatcttcaataaacttctatatctatgttttcacaatgtttaatattttaaataatgcttataatgttcagctgatcttcaggactcttagataagtaagttactatgtgggtgatgctaactagaggaagtagaatggaagaaatctaggttgtaataaatctttctacttttaattttctctta

SEQ ID NO: 82590 - DNA, 280 bp, Homo sapiens
gtgtggttccagaaccgcaggaccaagtggcggaagaagagcgccctggagccctcgtcctccacgccccgggccccgggcggcgcgggtgcaggcgcaggcggggaccgcgcaccctcggagaacgaggacgacgagtacaacaagccgctggaccccgactcggacgacgagaagatccgcctgctgctgcgcaagcaccgcgccgccttctcggtgctcagcctgggagcgcacagcgtctgacgcccgccgtccaggcccgggatcctggctgcag

SEQ ID NO: 82591 - DNA, 616 bp, Homo sapiens
tgcctttctagtttcagtaatttgttattatgctctgttctttcgttatttaatataatattggacctctttattgactgaaagattttctagctctggtataaattgtattttacaaaaactttataatatgcctattcttttttataatatttgttgtaaagcaactaacataaaaccttaattttcgagtaccttgagaatctgctgttctcaatagagacctttttagcttatttgcttttagctgtgttcgtttcttccagattttactgaatacaccaaatgtgtatgaaatgtcccatgtataaatgagacaaaattgaataagatatagtctcttcctttaaggagtttccatatggtatgattttacctacgctgaatataggtacttattgtaccatattataattcatttttaataaagcataagctttggaattcaagtaaagttgaatttaaatcctggatcattgacttactagatatgggaccttggataaattatacaacctttccccatgtgttcagctctaagggtatttcacctccaggttattatttcaggaattttattatagtcaatctttagtttttttaatagtaacagcca

SEQ ID NO: 82592 - DNA, 318 bp, Homo sapiens
tcagaattactcttttaaagatgtgcctcctatatacaactttaaggtggttttgttttatgatttaatctgattatgctgtcctcaaacaggacatttacatttactgacatgacagctatgttccatatcaattctgtcatactgttttaggttacgcttatacattctaaatgtctttcactgtgtagcctctcttttttttttttttttttttttttttggggagaaaaaaagttccccgtgggcgcgcccgggtgagaggggcgggggtggtaccccggataagggaagcccccgcccggggggaaagaacaa

SEQ ID NO: 82593 - DNA, 96 bp, Homo sapiens
  misc_feature (68)..(68): n is a, c, g, or t
ccaaattgtcttagagataattcccggctcacttagcattaggataatgacggttattctgtcccacngaagagtgttgaactggaacgcttccac

SEQ ID NO: 82594 - DNA, 389 bp, Homo sapiens
gacatatagctgaaccaaaaacaagataaacatctccacaggccagaaatgagacaaaactgaaaagccatgactgtggctgaggatacaggctactgggatttggtctggaagaggccaaagtagctttggctttagctcctgtggataaatagttcttgaagctttggggaaaggacctagaagtgctccagatgggatggggaatggaaatcaggctcattatttaatgccatgggctatagaaggcttcatgcttcagtcaaaaattattgccaacctttccctcatatcatagcttttagcaaagtcacattgttagcttgaagcctgtgttcacactgtttctgatacccacacagaacaggagcacagagataaggatggga

SEQ ID NO: 82595 - DNA, 450 bp, Homo sapiens
ggcctcccaaagtgctgggattacaggcgtgagccactgggcccggtcttgccatattctttaggtgctcagaactcagaccttgactcgttattggttgtgtggtggtggtagtttttttctccttaattatggtttgcaatttaaattttatcctacttatcataagttatgtgcttaaaaagcagatctgcagatctcactgtttcataataatgtgatttaaataggtgcactaacatttttcatccattcactaacacatttaaaaaatattaatagagccacttaacaatgttcaagcatggtgctgagctagagatacaaagctgaacataagaaacacccctgcctttagggggcttacactgcaggaagaaaccgctgtgtgaaacaataggcagcataacttgccaaggttgctgtgatctgagtatgcttgaggaaacc

SEQ ID NO: 82596 - DNA, 300 bp, Homo sapiens
ccaatcaatctgactgatgttcttatagaaagggaaaatatggacacagagagagacaccagagtgtcgtgcacataaagactttgaggacacttcataatggcgaccatctgcatgccaaggagaaaacagcaagcctgccttcacctcaatcttgaacttccagtctccacaacactaagaaaattaatatctgttgtttgtgctacctagtcaatggcattttgttatggcagcctgagcagattaacacacaaggcaagaatctgccttttctttctttctttctttctttttttt

SEQ ID NO: 82597 - DNA, 319 bp, Homo sapiens
tttttttaagacatatgccatctaagtgactcccttaagccgaaatataactttgtagcctttctaaattgtccatggaggaaacagggactctggagccagatacctatgtgatcttgggcaagttacttgactgttctgtgcctcagttttatcacataaaatgggaataataattgtacctcttctgaagggtttttattaggagttaggtggagggcttatgcctcagaacagaaggttgtgatatttgagtttgcgaagtcatcagctttatcagaaattccaccacagcaaattgttggcctgatgctatagg

SEQ ID NO: 82598 - DNA, 442 bp, Homo sapiens
tggttggattgtgagtgtggcttacagaagcatcagcatcaccttagtgcccccctccctcccctcaccctgtggatcttagtcacatgtaatataaccaagctcctgtttctatgaaagaaaccaacaggcctatctgtacacagcacttcataaatcctttttaaaaaaagcagaggaagataatggaatattttgccacttctaagagtgggtaataaatgtgtttgtaacccccagcccagaattgataggatttaatgagaaagtaccttttgcttgattttgtaaatgtaatctttcaatttatagacaagcaaaaatgtacccaagatgatagatgtcattaatgaaaatgttagtttcctaaccccccatccacctacccccacaaaaaattaagaacacattttagaaatactctattagaagagctcaaaca

SEQ ID NO: 82599 - DNA, 425 bp, Homo sapiens
ggaggtttccggcccggggcccgactgcgggtggcatttctggctaagccgttaggcgcgaattttctgtggccagaaaacacagggcacgttacccggtatcgtggtctacacctcgcccacaaatccatcccaggctgtatcctcatggaagctttttccagatgtgcttgagggttaagatggcaatgtgcaagaagaaaaactgcacattggaaaaccttctcttcggagatatctatatctatatttatatatatttacagatatggagatatatacacacacgtatctgaaaacattctgacgttttaaaaacggagcaccagaggagggggacttcatctgacttgttcagcactgtctcccaggccctggcacagagggagcactcgatacacaccgatgggctgaaggtgtgaatg

SEQ ID NO: 82600 - DNA, 211 bp, Homo sapiens
aacagatgaataaactgaatttgtttatgacacagtacacaggaggcaaagtgtttcacatcatagacttcacttccaactccttggaatgttcatttctttggcttacaggagagactagacaggaaggccaggcaatgatgtgaaacactttgcctcctgtgtactgtgtcataaacagatgaataaactgaatttgtactttagaaac

SEQ ID NO: 82601 - DNA, 334 bp, Homo sapiens
cctgacgttaagcaacttgcaaaaccagaatcagaactcacacctgccaaaacagaaagtctgattcttttcactgtggcaagatatctcaacattcaagattttcaaagaaattttattcatacttttgaatttctattttacttaattattcgtactatgagaatatagagccacatgacttttcttaataataatgggtactaactagttcaactctttacatttcttaattttaaattttgctaggctgggtgcagtggctcacgcctataatcccagcactttgcgggggccgaggcgggtggatcacttgaggtcaggagttggagac

SEQ ID NO: 82602 - DNA, 248 bp, Homo sapiens
cccagcttaggcgatcaggatgccagtattacctttccctgcgggagagtggagcatggtgacttctggctggttgttcccctatcccttccccatcccaggagacagggtccctcatgctgaccctacatccagaaaccagggccactctgtctggtcaatcaacagaaagtgacacatccgtgcggagcttcacactgctactttggggacacttcctggctctcttccagggccaatggcaacat

SEQ ID NO: 82603 - DNA, 362 bp, Homo sapiens
ctcatatacataaaaagtgataagaatccgaaaagacagccaggggaattaaatgccagttggggccaacggggccctgatcacggaagagggcgcccccagctctcaatcttcacacaatccctgcacccagggtcacagagcatgcgcaggtccttcccgcccacttccggggcaactgccaaccaccgcgcaggctgagccccaggcaggaagcagcccacttggtggggttggggtatgagtccttcctcgcgggggctcggtgggtcctgagtattctttggccggatttgctgatccgtctgctccaggtgagctgggaaggccgcaggaaaggcccagaagggcctcgccaggag

SEQ ID NO: 82604 - DNA, 462 bp, Homo sapiens
cccacctaccactcaaacctccagcctcatcttctaccaaatctcccatcaggccagtgctccagcaaaccaccaggcactccctgcacaccccacagatggaggtttctcatctctgcttagaatgccatctcccaccaccatctcttatctctcatcttaggcaacctggtcaactcctatccacatttcaaaaccccaactaaagtgtctttcaggaagccttccctaacttcactagagagcaaaactttcctgccagtctatgctgcttctaggataatttcccatttattccatgaactataaatatttgtttccatatctatactttccccactagactgggaacattttgaggaaaggagttgtgctggagccatcctggaatcccctgcatttagcagagagcctgccttgcagcaagctgtgaacaaatgtttgttgaaagtacagttgaca

SEQ ID NO: 82605 - DNA, 490 bp, Homo sapiens
gaatggactagatctgcagagatcagagtccagatctcatattatttatcccttcctattagatatgtaatagggaatataaattacttgttaatttcacatatctgcttagtgcttgttcgtgtaggaccaaaatcagtcttgatacgttgtcctatcacgaaaatcaaggatagaaacattcagaagtcaagatcagtttgctagagtcacaaacagaaaggaagagaatttaaaaagacagtaaaaggagaggaaacaatttcatgtattcagccagtatatgagggaagctaggtatgtggggaggctatatagaaatatatatagaatatcatgggtagaaaagcatccattttttatatagcttcttgaatgttagagtaatttacataaaagaatagtcagttcactcttcactttaacactggtttctaaacaacaacctgtttatcagtcatgatctgatgaagttttcacaggtttgtag

SEQ ID NO: 82606 - DNA, 703 bp, Homo sapiens
  misc_feature (19)..(19): n is a, c, g, or t
aagcaggcggtaccggccngagtttatggatctgggtgcaagcaggccaagccccactcctcaagatggaggaggagctgctgctcccggtggggactccccagtaggccactgggggaagccccacgacccagacagcaggtggagagcagcagctggccggagatcgacttcagcgagaaactgtgcggagctccagcagctggacttcctggagcagaagagccgctgaaccccgcccctgctgatctcactgcacacagcctagggccccacccgccgaggactccagaaccttctcctaccagctcgcccagagaccaagccaagagagtggtctctgaggagcccgctagaaaggcaaggcgaggcccgcagagaaggatgccaagcctgtagaagcagagacgtcggggatgggggacctgccctgggcgccgccagaggcccaagcgcccagcaccgcaggagctggagacgtcgctgagcaccaggtggcgccggcgcggttcctacagggagcctggaggcaggctgcggggtggctgtgccgggagactggagcggctcctggctccgcgcaggcagggcccccagagacagctcatgcagcagatccgcagccccggggccctcaggcaccgccgcggctgccgccctcgctcagtcccgagcgcgtccaccctggccagccagctgcccc

SEQ ID NO: 82607 - DNA, 400 bp, Homo sapiens
ctgggatgacaggggcgagccaccacacccagccatatatagcttcatatatatgttatacttaatgtataacgtactataaaaacaatttataaaagtttaaaaaacgattaaaaaactataaaaacaatttatttttgcttttcagggtcagtgccagcggttgttcagcctacatttagtaccactattcatctattatattcctgtcagcttgagaggtacagtcagggagtacctcacatcctgcagatattcagcacaaatgtctgagcaatctggctagttttgttctactgctttctcagcaaaccataataggaggtgcagtggtttatctcaacatcttcttgtgatggccacactatatactaaagttgagctcacattatatactaaa

SEQ ID NO: 82608 - DNA, 716 bp, Homo sapiens
agacaggagagggaaagcggggctccctcctccaacggctctcaggcacagccacgcctccagcgctggcgccccgcctcgtctttgagttggcagaggacctggcccgcccccaccccaggcagaggctcagaggcgccccactttcccccttcaaaaggcgggccgggccgcgtgctagggcatccctccctgggaaggtgagtgggatggcgagactgagccagcacatgggaggcttcccagcacgtgggaagatcgggacttccctgctggggtgctccccgcggggctccgcactagtcctgcccgaaggacgcttttcgccacccccggggttgcctttttgttggccgcgagccctttaatgcgcggtagggggcggagccagatcttaaattctggcggttgggggcggagcacggcagcggagggagaccagaattggttagggagctggacccagagaagagcaagctcgggattgggtaataggggggcccgacagtagtgtgtagcgaggattggccctccgggcagggcctcgcggctggaattggcccccgcgggaggaccgcggggaattgatggagttggccgggggaacggagcccgccgaggccgctatggccccggcctcgaagaatgccaaagagggctcaaggagccacggtcgccggcggtggcgaaaagacaaggccaaaggtgagcgcgcg

SEQ ID NO: 82609 - DNA, 355 bp, Homo sapiens
actgcgcccagccagtccacacaactttttaaaaaaatttcctgacagcagtaacttcatggtccatacagcttaagaagtgtttatgctttaacaactttgtagctgtttgaaaaaataatacacaaacattgaaagagagcatgtctttatttcattctaactatacttactaatggaatatgtgcctgttggaattgcacaacttctcaaaatttggtatcagaatggacacctacacactcatttcctgttacgtattggttttcttatggtatttgcttttgtcatagcaactatttaaacccagctttgtgaaaatatgatgttatctatcaaaaggattgtaggggga

SEQ ID NO: 82610 - DNA, 845 bp, Homo sapiens
gtcagggacattgaacaagggacatgggtaccaagctgacctgaggactcagctaactaaagttccacatttcttccctccttcccttgtctacctcttttccgtcaaacgtaagtggtcctctaggggttggctctctcatggtctttctcttctgatctgctctgccccgtcgtgggcatcttggaaccacctcagaagcaaggccacagctgtggactggtcctcgtgagagtctccctggatcctctgtacctgtaataggtacacagttacgttattatccaacctccaatccccaaaaagcctccttaatttgaaagagaaaaggtatatgtgccttgcattttgttatcggtccagattttgcatctggtggtggctggggtgccattgggattttggaatgggagcagtttgattcctccctcggaaggaactcatggctctcacaaaccagtgtctgtggcagtgacaagtcacagaatttgtgtttcaaggcttattccttcttccctttaagactttttcaacttcctgtcacttcgggctgagtctcaatttcagtcatgttttgtggcttcctttgagcacagaaacctctccttttcttccgttactggaactaagatcccagcgtaaactcgtgagagtcatttttccacgtcatcattcgttggagctattaagcccgaacacagaatgacattagtgttatactaatgtaagcagcagccactctggtgatgttgcattgaactcttttgttcttaaaccagattcacggcgggcaggcacagagttagaagagtgggctgcaggaagacacgtgctcagcggtggct

SEQ ID NO: 82611 - DNA, 244 bp, Homo sapiens
ggctacacacagaatggttttattttgtggtgctcagttcaccaatttatcttgcttcctacttggctcaaaccaacacaaagcaaaaccctccacagctggtcacggcctcattctcaaaactgtgagacttcccaacttcactgacagcctgcctttgggtccggagctaggccaccacgtgtgtggcggtgtgcactctccactgggccaccactccaccctccctgaacgccctcacatg

SEQ ID NO: 82612 - DNA, 1520 bp, Homo sapiens
tatcactgtattgagtgtggcaaggctttcagccaaaagtcgcaccttgttagacaccagagaattcatactcattagaaaccctatgaatattgtgaatatggcaaggccatctgaaggaattaacacctcattgcacattacatgatcacttccagagtagaaaactatgaatgtgggatagccttctgaaaaagccacaaatttatgaaacattagagaattcttccaaggtgacaaattatataatgaaaaagctgattaccagaaactttcagcagacatcttattgataatatttaatcagcattctcattgaaatctgaaacaaggtatcttccatcagcataacaacacaacacttgagctcctagccaatgtattaagtaaggaaaacaagtatcaacgaagaactataaaaataacttttatacaagaaataattagaaaatgtgttgatagaaaacctaagaataaacacaacaatgagttaggtctttatcaagttataaaatatgttgaaaggcacaaaagaacacctgaaaaatgatattttgtctgaaaagacttgacattgtaaaaatataatttctctcccaaatcactaagtttaatatacttctgaagtttacatcagttttattttaaggaacttcacaaacttatccaaaaattttatgtggaaaagtaaagaaacacaaatagctgaaacaaacttgacaaagcaagtagagaagacacactctattattagatatatcatgtacttatttaaagctgctgtcatttaaacaatgtattaccaagtgaataaatcaagcagtagtaagatagtgagcattcatacaaaaatccaagaagatacaggaattctgtgtatgacagtgctattgaaatcactggggaatgaatggcttatttaataaatggaaggttcataggagaaaaattttagctttctactttatatcatatacaaaaataaaatccaactaaagaccagaatataaaaagcaaaattttaaaactatgatgaaagtagaatccgttactttagggtaacaagatttctttaaaaaacatgtaaacatggaatagtctgttgaattttggtgtattggcctcacaggcacccacaaatgtacacaaagagatatatatcactgtgttcctgaatcatggtttgtattgcccaaaattggatataacaaatttttatcaattgtggaatagatgaataagtgtgatcatttctgtgataaaatacagaatttagaaacaaaatctacctatagttatatggatagattacaatatataatattgagagaaaaaattaaaatgcacaaaggaacacagtataacatttgtataatttaataagatcttgcaaagaacagtactgtgtattggtcatggatccatatatgacttggttgccttttgggatgtgggaaaggtttggtgggagttgttatatttatctgtaatatttctttaataaaagagtgaaagcaaat

SEQ ID NO: 82613 - DNA, 426 bp, Homo sapiens
ggcagcatttgaagctgaaggcaaggagatggatttctcattgagagcctccaggcagcaacacagtcctggggcacatgcgttccagccggtgagacccctgttggacttctagccgcagaaccgtcaggtccgatactggagtttatagccacttggtttgtgcgaattggctgcggcaaccacaggaacctcacgtggggtctgcacacacagttcacaggaagggaaattaaaatgacctctcatgtacagaggatcctcagtctcataacagggaaacgcaaacttcttggggagagaggcaaaaagcaacacaccctgggccaggcatggtggctcatgtctgtaatcctagcattttgggaggccgaggcaggtggatcacttgaggtcaggagtttgagaccagcctggccagtatag

SEQ ID NO: 82614 - DNA, 348 bp, Homo sapiens
cacttgcctttaggcctgtaggcctttcctgtgtgcctgcatctcagggagggtctctctccatgttgttgcctctatgttagtagtagacaactgttattacttggttcttgctgacctggtgagttggggggcaggggttgtcttgggccagcctcagtttttgtcaggccatgaatccctgggtcttgagggtgggattttttagtgatcctgccctcttccactggtagaaggcctttaatgatctgggcccaggatgatttcctgcccttttatcatgggtggaatttttttttccatttccctcactctagtcacagtgaatctttaactgtgtcctgaggg

SEQ ID NO: 82615 - DNA, 394 bp, Homo sapiens
aaggaaggaagcagcttacctgtggtcaagatgactaaaatcttgtaaattcaattccctggtgtcttgggtaagataaattgtatccacatcctatttgaaatataattcagtcatgtcatcagtccatgcagatgaccaggaaagcaagagagacagtgagaattagacaatgacaatggcaggtttttatgtaatctgagaagtgaagattttaagtgaaaaataaatgaagggaaaaaaagaaaaacaagccagccaaacattagaatattctccagggagtgtgtgtgctcatgcacatgtacacagacattcttacccattgtacttcttccctgtatgaaaatccaagccagtcacaaacacaggcatacatctgagaaaatccacc

SEQ ID NO: 82616 - DNA, 372 bp, Homo sapiens
aaagacacacagagagagagagagtctattgagtgagagtagcgttccaatccatccaacaaccgtatgctcacagagcattcaaggaaaaccactttgacatcctccagggagtatgttttgagtggagatacacaggcctgttatagtctcccagcttcttccctgtccttttcttggaagtcatgaggcacggaaaagaaaggagagggagagggagcttaagatttaccagcgatggtaaaaactccagttgaatcttaagtcattagtagaaattcccttcattttactcatagaaggttacatttttaattcattaaaatgaataaaaatctaatattttatatggaatggtgtaagcctgcctcc

SEQ ID NO: 82617 - DNA, 362 bp, Homo sapiens
ttgaaaaagaggctgggcatggtagctcacacctgtagtcccaacgctttgggaggccgaggcaggaggattgcttgagtccaggagttcaagaccagcctgggcaacacggcaagaccctgtccccccacccccaaaaaaggtaatactaaaagtaaaaaattagctttcaaataaagctagaaaaagcacaacaggataaacccagtgaaagcagaggaaagaaataaaggaagaaaagtaaatgaaagaaaaacaggaaacaaacaagaacagctgtcagcaaagaacaactcgcagcctaattttgaaacatctgtgaataaaaaaagtgccttttcccccatttttaaaaggttgtt

SEQ ID NO: 82618 - DNA, 765 bp, Homo sapiens
gcatggccaagctcaccctcctcactggtctgctccttgtgctgacagctgaaataggctctgcctaccagctgacatgttacttcaccaactgggcccagaaccagccaggcctggggtgcttcaagcctgatgacatcgacccctgcctctgtacccacttgatctacgcctttgctggaatgcagaacaacgagatcaccaccatcgaatgggatgacatgactctctaccaagctttcaatggcctgaaaaacaagtaaatgacggaaaacctgagtttcaaatcttttaacctttaaggacagtttaaacaagatcttccacagcagacttcaggctgaaattccaaacaggccaacaagcaggtaaattcagctttcttattatttcaagtgcaagaatgactctaattttaaggggaatggctggctcacagaagctagctgctaactaaagcccagctcagttgccaagggaagcttataagtccaactactggtggactcagttgagaacaatcttccacttagaagcaatccaaagctggcattgataaagcattcagtctccttggtcaggagattcactcctagggaaataattggaactgtggagacattggggtacagcaaaccaacatggcacatgtatacctatgtaacaaacctgcacattgtgcacatgtaccctggaacttaaagtatatttaaaaaaaaaactgtggagacattgaaacataccaatcatagtcacctactccaa

SEQ ID NO: 82619 - DNA, 402 bp, Homo sapiens
aacctgggatcactgctaatgaggaggttgagaaatcagtcctttcacatattgctgttgactgcataaactgctaaaattcttctggaaagcactgaagcaagaaaccccatctctggagcaagcttaaagaaataagccagaaacacagagtaagacagaaacacacaggtaacgtttaccgagcatctggtaaataccagccactgtgccaagtgtgttgtggtattgcttcatttaatacacacagctctcctctcaggtagataggattctatccccattcatacacaagggaacaaagacagtgattaagaaacttgcgtaaggtttccaggaagtaaaaatatactacatatataaaattgctcactgaagcactacttataatactgaaagcat

SEQ ID NO: 82620 - DNA, 339 bp, Homo sapiens
ctctgagaaacaccgcaatctagcagcagaaataacacaagtactcaaagaaagacttggaatgcagtaagatgagtgccatgtgagtgatagcacgttgtaggaatgaaaaggtgggaaaggagttctcagaactgaatagtgaagtcttcagaggtagtgtttgaattggctcatgaaaactgggtaagattttgatgggtaggttgcgggtagaaacaggcactagtagaagagaataacagatgcaaaagtttgaatcctcagaaaatggtatgttgttattagataagtttggaacagaggaagcagtgagagatgtgttgaagatgggggttg

SEQ ID NO: 82621 - DNA, 421 bp, Homo sapiens
ttactggcatctgtcggttggcttggtgttttaaatcttgagatggaagaggagggaggaattgaaatgtatggattaatctgaacatccaatgaatgtatttggccagtaaggacagttttctcttgattttgggtgcaaattgtttgtttttaggagtatagatttgataggaaataagggcacttcagattcaagcacttctcttctcacacaggagtatgcatgggaagaaaaaagagatttgttagtagctgagggtttgagagagggtagtgggggagggatgaagaagggaaaggttttcaaatgcatgtgacactgagctagaggggtcactgctgcctgcagatgccacaaccccatttgtgcacttgagcatggcctgagggagcattggcctgatgaatgcagagagaca

SEQ ID NO: 82622 - DNA, 820 bp, Homo sapiens
cctggacaagcctcggaggaccaggcagaaccctctggctagcagaaaagctcgcacccccgcacccttgcggcgtctgcttcagaccctccacgcaggcgcccgctggagcgcctgctggggatggcgtaccaccgacccttcaggctttttaaaaacctctccaagagctcggtcatgaaggagatatagacgatggccaggcggagggtctcgatccgggacagccttttctcgtaagcaaacgtgggcaccttcctccgcagctggtcaaaggcctcgttgaggttgaacatccgcttcctttcgcggatgttggcggcctggcgctgggcgtaggtgatcacccttttcctcttggggcggcctaatagggagacacctcttccgcgctcctcttcctcctcctcttctccgtccccctggtccacttcgcactcctcttcttctgggtccccctcttcaaaccgcgccatcctcctgggtcttccctctcggagcgcaagggctgggtcccccaaggagaccccgggtgcgaagtcgcagaggagagggcgtctcggggaggccagggacaggtctgcgacgaagtccagcaccgtagtgtccacgcagctctccggataggccgccatcgcttcggcttggccctgcctctcatcggttttccgcagggaggggcgaggttgctggtggggattcttaacagccttgaatctgatggggcaccatcaccgaaaggccagggaacattaaatatttataaccaagctgataacaggattagtcgcaccgataaggaatgctctgacaacgtccc

SEQ ID NO: 82623 - DNA, 416 bp, Homo sapiens
cagaggatcccctgccggctctctaccttgcaggcttctctacctctttctaccacacaagctccagctaaaggctttcttcccacgaatcaattttttatcttctcccaccccctgccagaatctccgccttatccaaattctgtttctctcttaacatcttctaattcatattacaggtttgttgttgttgttgttttgagacagagtctctctctgtcacccaggctggagcacagtggcacaatcccagctcactgcaacctccacctccggggttcgagtgattttcccacctcagcctcccgagtagctgggattacaggcatgagctaccatgcccagcctgtggttgtctataaacagggttgatcatttacacactaatgcttctagcagcactatgaggtagagag

SEQ ID NO: 82624 - DNA, 3290 bp, Homo sapiens
caaacacaaaaaaccacccaactacaaattaggcatcctcccacttggtcttttttcagattcattttggcttaatggtgccttccccattttaaaagcggtcttttactcatagtgccccagccttttgaaggcacaggaacaggagctgggctaccaccttcaagggctgtcaaagatggtgaggtctgaagccaaaggcaagcacaccaaactccatgggggctgaatgctgtggtctgtagtgtctgtgcttctgcagggttagcctggtcccagaaagagggcatgtgcatgctggagtgaagagctgaatttgatttccaagcccctggctgggggtccagagggagggcaggggccacctcctgccggctccctgctattgttgctcagggccggccgtcttggtggtcaccagttcagtggagcccagctctgtggctggcacagggacactgtggccaggtggggtggttcctgggtcttccccaggaggaggccggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82625 - DNA, 251 bp, Homo sapiens
cgggtagcgttctagaggatcccggccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82626 - DNA, 933 bp, Homo sapiens
cggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctcttgaccaattatttgacattcctaaagaaaggaagaatgcagagtataagagatacctagagatgctgcttgaggtaccttcagggattacaccagatagagtgaagcctctccaagatccggaatgaacttttcggggaagcattcagggtgaggttgggaagcaatgggggccaatggggacccctttcctggggttggccgaaagaagaaaagcagaggcctgtaccatgggtggggccattttgactcttggggtctcccccgggagggggtgggcgccccggggtgggcggcagggacacgggcccttgctagggg

SEQ ID NO: 82627 - DNA, 929 bp, Homo sapiens
aggcactactcaggtcgaaactaccgagcaggcagcgtccagggccgcgccaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctcttgaccaattatttgacattcctaaagaaaggaagaatgcagagtataagagatacctagagatgctgcttgaggtaccttcagggattacaccagatagagtgaagcctctccaagatccggaatgaacttttcggggaagcattcagggtgaggttgggaagcaatgggggccaatggggacccctttcctggggttggccgaaagaagaaaagcagaggcctgtaccatgggtggggccattttgactcttggggtctcccccgggagggggtgggcgccccggggtgggcggcagggacacgggcccttgctagggg

SEQ ID NO: 82628 - DNA, 2819 bp, Homo sapiens
aaaattcacgcttatggtacgagccccgttatcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82629 - DNA, 2938 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccattcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82630 - DNA, 2834 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatggctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82631 - DNA, 2499 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82632 - DNA, 1935 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacactacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82633 - DNA, 2833 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagatatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82634 - DNA, 2641 bp, Homo sapiens
gacataagtgcataggtacgaggcctggctgtaaatcggccgaggctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagatatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82635 - DNA, 1892 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctcctgaagaatatgaagactcaagtgggaatgttgtgaataagaagacatacgaggattagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaa

SEQ ID NO: 82636 - DNA, 1575 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctaatttgaccatcaggctcacggcactga

SEQ ID NO: 82637 - DNA, 2240 bp, Homo sapiens
ggaataacaagataccaaaaatagaaaccctttttgctttgtctgcattgtgtgttcctctgtagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82638 - DNA, 2271 bp, Homo sapiens
ctggagagtttagacttactgctagattggctgtgaaatgtgtggtcctgccacagcctcaggaacacccaccctctggcctgcatttggggtttcccaaaaatctgttaatgtaatattgtgatttttctcttctttgtataggagttggcttctctgggtttggacagattgaaatctgctctcttagctttaggcttgaaatgtggcgggtaaggaatagtttttctatcaaaactatcgatttactgtgtgtttgcacagtcttctaagtagctctgattccattttttttgttgctccacactgcaaaaataagccagcctgtgtggtaaagtaaccctaaaatcctttgccgtcctgtctccttaggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82639 - DNA, 1668 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggtaaggaatagtttttctatcaaaactatcgatttactgtgtgtttgcacagtcttctaagtagctctgattccattttttttgttgctccacactgcaaaaataagccagcctgtgtggtaaagtaaccctaaaatcctttgccgtcctgtctccttaggaccctagaagagcgagcccagagactattcagtaccaaaggaaagtccctggagtcacttgatacctctttgtttgccaaaaatcccaagtcaaagggcaccaagcggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaa

SEQ ID NO: 82640 - DNA, 1954 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82641 - DNA, 1579 bp, Homo sapiens
atttgatccaacttttatagcaaagcaagatcatgatgaattttgcagtggaaagggttttgtctataggtggtccagaaccaaaactctggtttggggtaggcaagaatctcaaaggcagagtcttctagggagcatcctaatggcagggagagaggattataacactggatacccaacagatgttcagtccatcctgattgctgttcatttctcatcctgcagtgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82642 - DNA, 1778 bp, Homo sapiens
ctggagagtttagacttactgctagattggctgtgaaatgtgtggtcctgccacagcctcaggaacacccaccctctggcctgcatttggggtttcccaaaaatctgttaatgtaatattgtgatttttctcttctttgtataggagttggcttctctgggtttggacagattgaaatctgctctcttagctttaggcttgaaatgtggcgggtaaggaatagtttttctatcaaaactatcgatttactgtgtgtttgcacagtcttctaagtagctctgattccattttttttgttgctccacactgcaaaaataagccagcctgtgtggtaaagtaaccctaaaatcctttgccgtcctgtctccttaggaccctagaagagcgagcccagagactattcagtaccaaaggaaagtccctggagtcacttgatacctctttgtttgccaaaaatcccaagtcaaagggcaccaagcggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82643 - DNA, 1346 bp, Homo sapiens
  misc_feature (33)..(33): n is a, c, g, or t
  misc_feature (39)..(39): n is a, c, g, or t
tagtctgtcaggtcacccgccccaaacaaccgncctggnagaacgcaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82644 - DNA, 1396 bp, Homo sapiens
gcgactcgctggtcctccccttcgtgaggcccacaaccctgaaacttgcagacacggctctacagaatcagaatcggcagcccctgaacagctgacgcgaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82645 - DNA, 374 bp, Homo sapiens
gaagatggagacaatactggagcagcagcggcgctatcatgaggagaaggaacggctcatggacgtcatggctaaagagatgctcaccaagaagtccacggtgagtggggcctgagcagaggctgcggcaggagcacgagcctctatcccgtgtttgacctctgagagcttgctttggccctcagaacctccctgccttcctccgggctccctctccgagctccggtcttggtaacctcctcccggggtccggagccccagaggcctttctgcctcagctggtaaaagctgagcgggtaagctccgccctcgggcggccttttctactccagaacgcaaactaacggcgtttgtgtcaccgtttgttttttcag

SEQ ID NO: 82646 - DNA, 522 bp, Homo sapiens
aggggtcagcaaaagttacaggaaaacaggaaatttcccttcttattctgcactacttttttctgacttttcatttatggacctgctcttaggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaagtaagtctcagcactaccactttctccccattccccattttggaaacagatacagagtttagtaggctaacacttcttggttttgttttgtttttttcttttttagcctattccctactggctgtataagcttcatggcctaaatatcaactacaactgtgagatttgtggaaactacacctaccgagggcccaaagccttccagcgacactttgctgtaaggaattcagagccatttttcctgggaattgaagtaaaaacatga

SEQ ID NO: 82647 - DNA, 2001 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaa

SEQ ID NO: 82648 - DNA, 2992 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82649 - DNA, 2783 bp, Homo sapiens
ccccgcgggtgtaatggcacgaggctcgtgccgttgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82650 - DNA, 2853 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82651 - DNA, 2443 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctggagtgcagtggcgcggtctcggctcactgcaacctccgcctcctgggttcaagcgattctcctgcctcagcctcagaagttgctggttacaggtattttttcttgtgagatc

SEQ ID NO: 82652 - DNA, 2685 bp, Homo sapiens
ttttctactccagaacgcaaactaacggcgcttgtgtcaccgtttgttttttcagctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82653 - DNA, 2638 bp, Homo sapiens
aaatatgctaggtacgagactcggtgtttgaatcggccgaggctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagatatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82654 - DNA, 2942 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaacatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82655 - DNA, 1298 bp, Homo sapiens
tttcctatgcccgctgaaggcatctgcgaacctctcggcatcgctccaccacacctcccaccagcaggtggcactgtcgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggtaagtgactgactgctgaaagtggaa

SEQ ID NO: 82656 - DNA, 1835 bp, Homo sapiens
aagaaccttatccttggaagtaaggggtcagcaaaagttacaggaaaacaggaaatttcccttcttattctgcactacttttttctgacttttcatttatggacctgctcttaggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcgggtgggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 82657 - DNA, 450 bp, Homo sapiens
ataatagaggtatgttgacatgaaagcacatgagctgcttaatgttgggtcatagcatcatcacatatggaagacacactgaagccttatgtttagcaataagactgataaagtttatctgtctagattgtaaaaatcctcacagcatcagcctaactctcatattaatcattctaactcaccacttctttttgtagtcatctgccactacatttatcccattccctatttatagttgtaactgtatagtgattacagtattcatctagatgattctttcagtaccttagcctcttattccttttgttctccatttattactccctttaccactcttacctattactaggagtccatttgtgatctatttcagactttctgttttccctaccgctacttctgtctttccaggttcacttcctgtagggctctaactctgtagtcttttgc

SEQ ID NO: 82658 - DNA, 709 bp, Homo sapiens
cttaaattggcaactttgacacataattccatgtagtagttaatcttgctagaagatcccaatgttgttattctaatacaatctgataatgttcactggcattttccactgttggcatctttactatagcctacagttgtttgtttgtttatttgagatggagtcttgctctgttgcctaggctagagtgcagtggcgtgatcttggctcactgcaacctccccctcccaggttcaagcagttctcctgcctcggcctccctagaagctgggattacaggcacgtgctaccacgcccagctaatttttgtatttttggtagagacgtggtttcatcatattggccaggctggtcttgaactcctgacctcaggtgatcagcctgtctcggcctcccacacacagtgctggggttacaggtgtgagccacgattcctggctgcctacagttctttgtaaagcagacaaaatagtttcattttttaaagaaatgaacatatatgaggcaacctgtacctaacttaggagttcagaaattccctggactgcctatacattttggtttctcattcctaattcccaaagattaaaatctgtcaggaatttggaaacattgaatcacaggccaaaataggaccatgtctccattcattcattcattcaacaattatttattgagcgcatgctatttttcaggcactgtgccacat

SEQ ID NO: 82659 - DNA, 564 bp, Homo sapiens
ccctcccctgcagggagggatcatggcttttcctcctccacatacacacctggctggacagttttcactttttgttaatatttagatattacataatagttatgcacattatatgatccgtatttaggggcgtgtgtgtgtctgtgtgtgtgttagacatgggatcttgctctgttacccaggctggaatacataatagttatgcacattatatgatctgtatttaggggcgtgtgtgtgtctgtgtgtgtgtgagacatgggatcttgctctgttacccaggctggaatacataatagttatgcacattatatgatccgtatttaggggtgtgtgtgtgtctgtgtgtgtgttagacatgggaacttgctctgttacccaggctggaatgcagtggcaccataatggctcagtgcatcctcaaacttctgagctcaagggatcgtcttcaaactcctgagcctccccagtagctgggattacagtgtgccaccaacacacctggctcattgtgtattttccactagagacagggttctccaatgttggcaggctgtctcgagt

SEQ ID NO: 82660 - DNA, 425 bp, Homo sapiens
tcttatacccttactatctgcctaaataatttctatctcctgtatcaataacagtaataatcatgatgtttatttaccacttacaacaggacacacactgttctaaatgctttgtgaagattaacttgtttacaggctctgagcaaatgctgttattttgtccttttaacaaatgaggaagcacaagcacagagaggttaagtaatttgcccacagtcacacagctatgcagtagaatagggagtcaaatccacacagcccagcccctgaatccatggatttatctactgcaccatccttcaagtgtctctttatgcagatacgagcaaatctaaacatattttcttttcttcttttttttttccaaaaggtagcacactgctgccattgttctgcaatttggttttgttctgcacttaacacga

SEQ ID NO: 82661 - DNA, 157 bp, Homo sapiens
cattgacttgtgacaaccaaaaaatctctagaaattgccaaatgtcccctgagagccaagatcacatgtgacagaggatcactgcctttcacgactctcagtaaaaagaatacaaaccaccgggcacggtggctcacgcctgtaatcccagcacttt

SEQ ID NO: 82662 - DNA, 402 bp, Homo sapiens
ccatgttggtcaggctggtctcgaactcccgacctcaggtgatccgcccgcctgggcaactaaggatacatgggaagatacctggagatgccccttgcatgcaaacatctagatacaaaggtggtgctagttatggaaatgtacaagtgcagggaatgatcaaagctcctgaaagagggccccctcaggaggtgctggaacaatagggagagcaagggagagtgaatggagaaggcttccgatgtcccaatgtgctacagaatccatgttataagtggcatgcgtgggaccctattaatacaggtggcctttgaaggcaagtctaagaatgttatatcattgtttccatgaataaatatagccacagtgtgtttgttttgttttgagacagagtttcgctct

SEQ ID NO: 82663 - DNA, 372 bp, Homo sapiens
aaaataaaaacatcagcaggcctatatgccttcgctttcatcttagcagtgcctgttaacagtgaaataatgtgctcattttcatattcgcactgattactctaggggcgcagatttaccagagagacatatcatgaaacccagcaaagggatactgcatctagcagttctggtggtgttttatcattaccttttcacttgagcataaaaactgtttgacaaatactaattgtaaccagcagagctgaatagaatattttaagaaacaaccctaattttcatgaattacatatttgagttcatactgctgcatgtcaagaatgaaaatcactattacaatgatgaaataaagggcatctgtggatttcatct

SEQ ID NO: 82664 - DNA, 409 bp, Homo sapiens
accccttgaaatgtgacctgagttggaaatgggatctttgcagatgtcattagtgaagacgaagtcacactggagtaggctgggccctaaatcaaatggctgttagttttataagaagagggaaatttggacacagacacacacaaagaggaacaaccagcgtgtgaagacagaggcagagattggaatgaggcagccacaagccaatgaaccgctgcagctcccagaggccagaagaggcaagggaatatcctcccctagaggctgcagagggagcacagccctgccagtgccttgattcgagacttcgagacttccagcctccagaactgggaaagaataaatatctgctgttttaagcactttggtttgtggtgctttgtcactggcagccctgggagtagtccag

SEQ ID NO: 82665 - DNA, 443 bp, Homo sapiens
ttaattggttcttggctctgcacgctgtactggatgatacaggatgcatgatgctgacatctgctcggctactggggaggcctcaggaagcttctaatcatggtggaagatgaagggggagcaggcatctcacgtggccagagcaggagcaaggggttgggtcacacacttttaaacaaccagatctcatgagaactcaccattgccagaacagcaccaagccatgagggatccacccccatgacccaaacacttcccaccaagccccacctccaacaccggggattattgtcaacatgagatttcggggacaaacatccacactatgtcgtagccttaaggggatcttacctctttgaagcattgtagagttcagagagtaggacattttgtctactgtattttaaaatactaaatgttctgattatgaaagtcagtcctgg

SEQ ID NO: 82666 - DNA, 248 bp, Homo sapiens
caatcgctcacacaaaagtgcaagtgcgttcacagcgccaaagaggggtgggtggaaatcttaaactgctcttacaagcactggtaacagtttgggaaaatacgtcctacagcatcccacgcgtaggtgaacttgggctctccgtgtgttcagtttggaggacatcgaccacacacaccaatcagcccagcagtggacgattgtaccaccatcgtcttctatctgaaattgttacagcgcttctctgg

SEQ ID NO: 82667 - DNA, 279 bp, Homo sapiens
tggcagactgaagagtttggactttattcctcccctttggattttatgagcttagaataggatggaggtgctactttaggacaattggttccagagcaataacaaagatggtaagaagagagaaaagaaactagaggtagagaggcagtcagggcagcctttgaaacagttgacctactttcttgactctctcctgccctgcagttgctcaggcacccttgctgctcctcctcatcttcctgtcctctatacctggaagtgcctggggctcagccttta

SEQ ID NO: 82668 - DNA, 447 bp, Homo sapiens
cactgttgcccaggctggtcttgaactcctgacctcaagtgatcctcccacctcgactcccaaagcactgggattataggcgtgagccactgtgcctggccagaaagtgttggttgaataaatgattaagactccctagcccagtgccctggggaaaggaaggcatggtataagtcaatcatagtccaagcaaaattataatatttgtatagtatatggagttaaacagactaggctgtttgctctgccccttatggctgaccccaagggctgatggcatcaataccctattagctaggttattgcataccttgcatacctattacctgttctgggcataccagttagggaattaagatatagatagttgctggagtacttggtccctctggagcagtactaggtctgtgaccctgagggtatgttgtccccactgcctgagcctac

SEQ ID NO: 82669 - DNA, 452 bp, Homo sapiens
gtgtatagaagagaacatttcccactggctgctgctttgtgggaagaagaggcataacaaaattcactcacccttccttaaacaaaagtagaggtgcaacttccctgtttgggtttataacactgtagcatctgaaactcagctgcaatactgaattaactgttttccttgtatggctgtggaaaatgaaaccaataactcctcttaatttctgagagcctaaatcccctaggtctgctgcattggaataggagtgtggtttctcgcccttacctttacaacttcctatcatctgaaattatttcaaaatataaagttaggaaaaaagaaagcaacagctctaagtgcagtatggcatcctggattgggctgctgcagcaggaaaagggacattgggaaaaatggtaaaatcccaaataaactcctagctattagtatgattgcaccttttt

SEQ ID NO: 82670 - DNA, 363 bp, Homo sapiens
tcaggacagttgtcctctgctggagagagctatcttggtggaatgcgttcctgagggcagaccacatccacagactggtcaatgtgggggtagaaagatcagctctattataaaggtatagtggttacaccccaacctggtgtaactgtgcacggccattccgccccagaactccctgtgggattgtctcagacctgcgttgagatcatctcctcgcaggccaaagtcatcctcttcccagtcccgtttcctttattctcccccagatgttgatcctgggagcatcaaggggaactccatctgtgaaacctggaggtcccctcaggatttgcagagatctaggggaaaagacccagacttttt

SEQ ID NO: 82671 - DNA, 745 bp, Homo sapiens
gggcaaagtaaggcgacatggttgtggtccctgtcctagcttcagccctgttctcttcttttctggatgccctcctccatctcccatgcccagcacactgtccatgaaaggggcttgtcttaggttctctagactcagaggctgagatggaattcttgtgcaaatgattaattgagggaaagccctgagaagaaacctatagtgagggggtggggatgaggagagaagcagtgtggggcagaaggggctgggcaaagatggggtttaggaatagtctagcctagacccggtcccactgggaggtctgcagcatctgctgcatctcagaggttgtcctgcccagctaaaggggctgagctgttacactctcccatctgtcaaccaaatgccatgcactgccccagggtagggtaaaatgtcccaggcatcatccaccaagaggctctttgtaaccaaggatagtgctttcaataaatgaacaagcatgtgagccgctagcagccagcatctggggcatgggtgctctgtgctggaatgattaagcagttccattcatgctagtgacatcccttaatgagaccccctacctccctccctctcttcccctcttctttccttcaacagatatttattagtaaaccaatcctcttggagtttagagtctaagtaaggggataggcagtaaacatgtaaatgaatgagcacaaaataattccaaattgtgaccattgtgaagtacagtacc

SEQ ID NO: 82672 - DNA, 252 bp, Homo sapiens
gagagatcaagcaatttgcccaaagtgacaacactagtaaactctagagctggaagtcaaattcagtctagcaccggaggccattctcttaaccactctattcttcctctgctctgctgctagttgacatcttttaagagatgccaggaagagaaataccctcatgagttgatgaaggccagttagctagcagtgcattcacacagcattgtcatttaactgcatgatttacccggttacctcaaaagaaaa

SEQ ID NO: 82673 - DNA, 235 bp, Homo sapiens
caatgtagtcgctcttattattcttatatgaccttcctatgaaatgagatgggttccacctgttcatgagccttttttgaggaaaggacaatatcacttagattcttaattcctaataaagatggaaatgggatgggataaaggttgctccattgaaaataaattgcattacaaagatgaatgtaataaacttgatgttttttagatctaaaacagactgattcagctttttaaa

SEQ ID NO: 82674 - DNA, 429 bp, Homo sapiens
tcctgtgatattctactttctgcacatcactctggccatggttatttagtttccccaaacagcccatggttgctcatggtccaccttcttggctgaccagaatcctgtgtggcctcacagtgatctgtcttccttgcctcttctcctgctttgctccagctaaaaggaaccactggctaggggcaggtccctagaaaaccagaaaatgaaatggccaaaatgcttgattttgttgctaagtaagaggccctacctcctctgagcacgaattcttcatggaaccgcagggtgctctagtctgggtggaaggcagcttcctgtaagtcacctgcatctaacaaaacgtagaggaatttgacatactgtcctcccccgaggttccacttcatttatgtgtgtgtgtgtgtgtgtgagtgtgtgtcaatttgt

SEQ ID NO: 82675 - DNA, 453 bp, Homo sapiens
ctgtctactttatattcctaagataatcaggcaggtgtgtgaagcaaatgtgagtggctcagtttcattttgaactcctgatacggatattagggatcttggacttagaaggtttgattgctatagtatttcagtaataggaggtctgcaatggcatccgatgttaataccctctctcaggaaagatgataatggcttttctccatccctaaatgaaccaaaaaatgatagaacagacatctgtggatggagattgctggaagattagtgtgaaggggaaaaaggatcagcaatagcgctgccgttgctgggaagggggtggggagaggctgtcgcagaggaagactaaacagtgacgagttaatgggtgcagcacaccaacatggcacatgtatacatatgtaacaaacctgcacattgtgcccatgtaccctagaacttaaactattatta

SEQ ID NO: 82676 - DNA, 440 bp, Homo sapiens
accaatgatgtcatgccttttcccgcatgtgtgtatacctttactgttgcctgactggcaaatctttctttctctctctctctctcacacacacaacccccccccgccaatgtgctcacgcatactcactcaggcacaaaattatctatctttagatttttgttggactcttctcttttgtaaaacaatcagcataacaactgaaaaaagaatttgaaagaaaggaatatttttcttcctcttctcctctctggctacctcccagcaaactaagctatgcagttctggattctgtctgacacatcttaactactgacatttagcagatgcttctcgaagaaatgggggagggtgaaggtgaagcaggggtgtgatataagtaattagactaacgatgtctcaattatcaagatgttcccacagtgtccccttctgttagc

SEQ ID NO: 82677 - DNA, 770 bp, Homo sapiens
ccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtggtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggta

SEQ ID NO: 82678 - DNA, 270 bp, Homo sapiens
atgtaggggtgaatgtacctcacacatgctattacatttcattctcaccacaactttgggaagtagatattatcatccccacgtgacagatggggacacagtatacacagattgagtaacatccaagattatacaattagtggcagagcagctctaactccaaagtccatttattttccagcatattattaagattgtaaagcactgcttttcaaagttaaatgtttgtagtgatcatctggtttttgtttttattttttaatgcatact

SEQ ID NO: 82679 - DNA, 397 bp, Homo sapiens
gatttgtatgagattagccggccgtggattcagaatcgctctttgtgtgatgggtcccaggggttccttttgaccacagagccagcctgaaactacccacgggtgctgtggaccccttgatcatggcgggatggaaatgggctgtgccctcagccgggactcaggactgcagcatgtctgggcagcagcctggaagctggccagcctcggcgcccttggggacagcccttgacactctggctcggtgccctgagtgagggggcgccaccctgggctccctgggatgcgagcaggacccaagccaggctgctggaccgggacagtcgcgtcatgttgctgttgtccccttcctgcagcatctccatactctcctaaaatcccatctgtcagacagtgt

SEQ ID NO: 82680 - DNA, 856 bp, Homo sapiens
ttccacctgaaactaccaaaatagaaaaaaaaaattttcctattaaaatggaaaaagtctaagtgctcaggtagaatcattgaattatcatttttgctagagttgaccttatgcatttcaaggctggcaccatcatgtacaggaacaatatgctcattgctcctcccacccatccccaccatgatgaagaaaagagctgattagtgaacaactaataaatatgtgccatctgggtactagtaactttaaatttttatttaatgtatttttcattttttaagaaaataccttgtgaagtagaagttatcatgcctttacaataaaaaaaaagctgaagctcaggggtgttaaattatttcccccaagtcaaacagcctggaagtcacataagcgaagattcaaacccaactgtcatgtaatagagcccacattctctccaccgtatttacgtgtgccctcagataccgaaaattctccacaaccagcaagaataggaggtacacatatttctgtactcttctcttccatttctctttttcccgaagaatcatactcattacagataaagtatctctctgggagatgctgttctttctttacctggaaccttcttccctttctggctccttctcatccttgaagtctcaacctgaatttttagacaggtcttccctctttagagaggtctttgctaacgccctagtctgaattagattccccctgaattctttcccgtaacaccctattcttgtcttttatagccctctccaaagttgaaatacgtatttatgtatagcgttacttgtgtaaagtctctccccagctataatacaatagcccaggctgtggtatattt

SEQ ID NO: 82681 - DNA, 417 bp, Homo sapiens
caaaggaagcccttggcaaaaaggtaaaaatgaaggacgcttcattcattctcaacattttgaaaattgtgtcttttattatcttcctgaacctctgctactttctgacccctgattccatagttttctctttaaccaattttcagctttagttttccctcaggtaacgcagagcaattcaacatttttataatcctttcagaaattgttgctttaatcctcttctctcaaacctcactcctagaccctggctgaaacatcttttggttctgaggaaacctctgtgaactgaaaatatactgaaaactggtcctgtattcgttgttcaaaattaattaaatagaagagttactttccaaaatagcagaactcattagagcatcagaactcagatacacacttatatgaaagggaaca

SEQ ID NO: 82682 - DNA, 392 bp, Homo sapiens
  misc_feature (93)..(93): n is a, c, g, or t
  misc_feature (337)..(337): n is a, c, g, or t
aggaccttgtggcaagagggactgtcccatgtggtggaactgaaagaaaacaggaaggccagagggcagagggcagagggcaggcagcggcancgggaggggggttagcaaggccaggccaggcaagccatggcccaggtttttctttgtggcctaaggtcattgggaagttatcacaacgttttaattagagttaaaaagcaaaagaactgtaagttcttaaaaatgggtcattattacattttttaaaatatctattgtcataattggttttcactgggaaaaagtcattgttgagataagtatgtgtttctgaaaacagttcatctctttttantgccatatattcttgtgtttagtaatctaaattcttaccatgtcggttggctcct

SEQ ID NO: 82683 - DNA, 134 bp, Homo sapiens
catgtttttatctggacagggccagcggggctttctggtttgacacaccatccaatgtagaaatgcctctccaacattagcgatagtcatgatctgacaagcatgtgcaccaagaacttcccttgggccaggca

SEQ ID NO: 82684 - DNA, 352 bp, Homo sapiens
ggctaaaattaaaaagattgataataacaactgctggtgaggaagcgagacagctggaaattttagacattgttagtaggagtttaaatttgtttaaccactttggaaaattttatggcagtttctacctaagctaaatgtttgcttcccttttgaatcagcatttctgctcctagctatgcactaggaaaaatgagttcatatgtccaccaatggatatctcaaataatgttcatagcagcattattcacaatagccccaaagtagaaacaacctaaatgtcttttaacaggagaatttataaacaaattgtagtatattcatacagtggaatactccacagcaataaaaa

SEQ ID NO: 82685 - DNA, 604 bp, Homo sapiens
ttgcagagtgcattcactttggtgctagtttcttcataagaatcatttaaaaactcatatttataaaataatgtctttgccaaaactaaattgagaattctgtgcttcctgtcagttaatggtgacttgttttgacctattcataccaaaagatctaaatgttagaatctgctaaaagtagaaattataactagaaaaatatgaaaatgtaagcaactccctagtaatgaatatttgaagttgtgtgaacaccttacctctactcgtatctacaaattctggatcagggaaatatcttttttaggttgttttaaagtagtctaggacctaaacaaacatgcattatttcattaaatcttagcaagtatgaatcaacaggccagactttgcctccagtttttttctgtgcctactaagcagcttccttctttatgttaaccagatctcctattagtcactgggcaagtatttgtttaaaagtcttgagaagccagacctggtggtgtgtgtctgtagccctagcaactcaggaggcataggtgggaagatcactttagcccaggagtttggggccagccttggcactgtagcaatacttcatctt

SEQ ID NO: 82686 - DNA, 568 bp, Homo sapiens
gcgtcttggtggtagtggtcccccgggcccaggtgtcttttggctgggatgggggatgggggatggagtggctggggtgggggatagggcggctggggtgggggatggggtgggttccacagcatcttctcttctctgggttgtgcttcaccagcacgtgggaaggagctggtgacgggtggtgccgagtgcgccagtccctgcagttagcgtcctggtcatggctttgctcaggttttcttggtctcctaaatataaaataccaactttatattcctcaggcacctttccctccccccctcattggttctctctcggccctgtgtagagggcagttcaacagagtcctgtaatatcctgaagtggaggggaggctgcctgcctgccagagagcagcctcaccagccctgtccccaaggccgagatgcaggcagcaggctggggcctcggcgtccagtactcttgtgaacccgcgtccgtccctcccggccatccgacccccccgagtggcgttttctgggctgtgtgtctgtcacctggccccacagttcgtgatttagagcagccc

SEQ ID NO: 82687 - DNA, 750 bp, Homo sapiens
atctgttagtaaattctgcctaggtcctggccagtggtgagccatccatgcacagagagaccccagagtccagcagaaggaggcagccggaaggtcaacagcaccaagcagagactgcagcagagattttcatttgagtccagacaaattaacttccagaacaaaaatcaacactcttcagaaaaaagaagtcactacagttaccatctacaatgtccagtacaccatcaaataacactagatgttcaaagaaacaggaagatgtggcccatagttggaagaagccaatagaaattgatcctgaggtaatgcaggtgttgaaattagcagaaaagaacattaaagccgctagtatgtgttcaaagatttaatgacagtatgatcacaataaacaaatgacagagcagagaaatggcaaccataaaaaataagtgaaaattctagaaataaaaactactgtaactgaaattttaaaatgcacgaaacttaatagcagtttgaagatggtgaaaaattacatatccaagaagttcaacaaaccctgagcaggacaaatacaaagcaaaccctcctaagaacatcacaatcaaactgctggaagccaaaaatcccaggaggagcttgaaagcacctcatcatataacataaaggagcaacgcagctaccagagtgactgacttcttagaaacagcaaaggggcaacatgacgagactatgaaaaaataaaatgaaaagtaaaaattgccagtt

SEQ ID NO: 82688 - DNA, 615 bp, Homo sapiens
acggcagctaaacagtcagccaattagaggttcacttggcagcagaggccagagccatgtgctgatctcatccaggctcaggaaagcacatcaaaagggcagagtaggccgggtgtggtggctcacgcctgtaatcccggcactttgggaggccgaggtgggcggatcatgaggtcaggagatcaagaccatcctggctaacacagtgaaaccccgtctctactaaaaatacaaaaatattagctgggcgtggtggcaggtgcctgtagtcccagctactccagaggctgaggcgggagaatggcgtgaacccgggaggtggagcttgcagtgagtggagatcgtgccactgcactccagcctgggtgacagagcaagactccgtctcaaaaaaaaaaaaaaaaaaagcagagtggcagctgtcaagagcaagactcacgtccattaggctgcactgacttttagtgtcacttttgcagtggatttcagaaccaccaagagtcttttaaaaatacagtagttttctacacaatagaaaaaatttaaaaatcttggactataaataagtttaatcttactatgtatcttctgcatctagatgttttggttcagcat

SEQ ID NO: 82689 - DNA, 750 bp, Homo sapiens
gattgaccctggtttttagtttattgggtatactgagcaaactcatactacaatatttgcttttacatatgctaaatataaaggaaatataaatctttgaagagagaaaaaatgttaaaagcacacaagctaaagaatgtttattttcaaagcattaaccatttagtaaaagggaatttaagggagcaaatggatcataacattttagagttataaagaatattacatgttattcaggccactctcctgacatcataggtgaggaaattaaagcccccaaaggttaactgaattgctgtgagtccaaatggttatttgatgggacaattggtttaaattcattgtttctaaacaatgcaaccaagaaaccatttattgggtatggcttaccatgcttcattctgcaagacacttaacacactgaacacaactgattagaccagggttgcttcttcagttgaagactatgaatggactagatgagaatttatgaagacattggcttggggtcttttgctcagtggatccattaattcctacaaaaacaaagcaacaaataaaaacaaaacctaactgaaccagttagatccttttggaagagtttgagtacaagaaatacttaaggttaccaaatagtagttggaaaaagtagaaagagatgttggagtcagaggagctgagtcatgagaaaaaaaagacttatggactgctgttccattctgaataagaattctactctttattcactct

SEQ ID NO: 82690 - DNA, 215 bp, Homo sapiens
ccttaggaaaacactttaaagtttaagagtgaaaaataagaattgaagtccttcctgggatgctaaagcacaggacaccaaatatcttggctgctggatatgaattaatttggagcatcacctctggctttccctgcaggaagaactaaatctttttttgtttgtttaaatagagacagggtctcctcatgttgcccaggctggtcttgaactcc

SEQ ID NO: 82691 - DNA, 438 bp, Homo sapiens
taatacataaaattggtaccaggggtggggtattactataaagatacctgaaaatgtggaaccaactttggaggaaaggttggtacaatttggagggctcagaagaaggcagaaagatgatggaaagtttggagcttcctagagacttgttaaattgttatgaccgaaatgctgatagtgacatggacaataaggtccatactgaggtggtctctgatgaagatgaagaacttatttgaaactggagtaatggtcacaactactgtgcttcagcaaagagactggtgacactgtgccccagctcaagggatctgttgaaatttgcacttgagagagatggtttagggcaagcttgtcaaacctgtggtctgtgggctgcatgctgcccaggacagctttgaatgtggctgtattagtctgttttcatgctgctcataa

SEQ ID NO: 82692 - DNA, 216 bp, Homo sapiens
ctggagttactggtagggaaatgatggcagccagtgtaggtgccttaacgaacaggtgacccactagcatctgggacataatcctcctgggccagtggaaaactccactgtggaaagccagcttcagtatttttccatttaagggcctacatttgggactgcccccaggagtattaaacacctcagcacttctggcctgcccatcctgcctgccaa

SEQ ID NO: 82693 - DNA, 156 bp, Homo sapiens
tgttgggattacaggtgtgagccactgcacctggcccttgtaactgatttttaaatatagtatgaggggtctaatttggtgaggaatttaattttgttttttccctatgagtaaccagttgtctcaacatcattagtgaatagtttttccttttct

SEQ ID NO: 82694 - DNA, 364 bp, Homo sapiens
ttttgtcgccaaaagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttggttacatattattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggtccagggcagaggaccaacgtcgacgcggccgcgaat

SEQ ID NO: 82695 - DNA, 541 bp, Homo sapiens
ttttgtcgccaaaagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttggttacatattattattgcgtttccgacaagttataaagttgtcattaccctctggatagtttacctttgggtgagtatactaactttctgtagaggtatacttgtaatcacaaataagaataaattatataaaacaattcacatttctggacttcattatgaatatgtggttttacccaaaaaatcagggaaatgatttattagcataagaattatgaaaatatctgccatttgcgttatgaaaattaaataggtcactgtttgtttaatagaatgtcaacagagcttttggtcaaaaataagtttttttaacctttgtgctatttatcacaaatggagtatgaggtttcgtcacttaaataggaaattctttctaaactc

SEQ ID NO: 82696 - DNA, 746 bp, Homo sapiens
tgtttctccatgttggtgaggctggtctcaaactcccgacctcaggtgatccgcctgcctcagcctcccaaagtgctgggattacaggagtgagccactgtgccagcctcatgtcattcttgtgtgtgtgtgtgtgtatgtgacagagtctcattctgtcgctcaggctggagtgcagtggtgtgatctcggctcactgcaacctccgcctcccagcttcaaacggttctctgcctcagcctcccgagtagcttggattacaggcgcccgctgccatgcccggctaatttttgtatttttagtagagatggggtttcaccatcttggccaggctggtcttgctcctgaccccgtgatccacctgcctcagcttcccgaagtactgggattatacgcatgagccaccgtgcccagccgtcattcttatattattatttcctaggtgtctctcctgaagactatcttctggtctcgaaatggacatgatggatccacggatgtacagcagagagcctggaggtccaaccgccgtagacaggaaggtatggctctgttggaatccgcatagtgtggaaatgagtttgccctggaaagggaaagaacagcttcttgccctcaggtttctcaccttctcctctcctcactctcaccaagggctgaggtccatttgtatgcacacaaagaaaagagtttcttcctttcgaggaaataaaattggcctgaaagacgtcattactctacggagg

SEQ ID NO: 82697 - DNA, 369 bp, Homo sapiens
agcgtcagctcactccccttccaccctcagctccaccctcagcagatgataatatcaagacaactgccgagcgtctgcgggggccgcttccaccctcagcggatgataatctcaagacaccttctgagcgtcagctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatg

SEQ ID NO: 82698 - DNA, 1197 bp, Homo sapiens
ttttgtcgccaaaagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttggttacatattattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattgtataactgataactccctgagcctcaagacacctctcgagtgtctgctcactccccttccaccctcagcggatgataatctcaagacacctcccgagtgtctgctcactccccttccaccctcagcggatgataatctcaagacacctcccgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatg

SEQ ID NO: 82699 - DNA, 411 bp, Homo sapiens
ttaatttctccataatctcttcatctgtcatcttagtcttctttttctgtttgttctaaagacttggcagcaccatccacatgtgaatcaccaactggtgcaggaacagggtcaattacagaccgtgtgtaaattgatttcgtatgatccggtcgcggggcaataacgggaggagcagtctcttcatcatcatgctcctcctttgtcagccaatcacagtttgaaacctttgccctctgttccagaagagaaaaagcccaggcataaaatcatctccatattctcaggcacagagaaaggaagtaaaaagaaagaaaaggaacggccagaaatttctcctccatctgattttgagcacaccatccatgttggctttgatgctgttactggagaattcactgacatgccctg

SEQ ID NO: 82700 - DNA, 2275 bp, Homo sapiens
ggtctcttagaatccattgattagaccagtagcttttggtagtaccatgatgtttccatttgacttttcaaacatttttcagctgaccattaccagctttgttgggggtaaactcaagagagttacatcttttacacattgatttttccagattttgcaaatgtcactataaatggataatattttctaattgggagttgtggcaggggtagttattactgttttttgcttgttcgtgctattttttactttgttactaattgtattttttccaattccaggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggaagtaaaaagaaagaaaaggaacggccagaaatttctcctccatctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggccttccttctggaacgccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagcctaagatgacagatgaagagattatggagaaattaagaactatcgtgagcataggtgaccctaagaaaaaatatacaagatatgaaaaaattggacaaggggcttctggtacagttttcactgctactgacgttgcactgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcgaaaagacaagtatgacttttatatgaaccccttctttaggggtccagaaggatttgtgggactgaattcactaggcttaggtctttcaggaaacaggctatcaggggcatttatcatgtgtgagattggattctacttgggtgatttggtggatagacccatgaatggcccctgggggttttcaatcttggattggaggtgggggtttcagagtgttgccacgtctagctcctctccc

SEQ ID NO: 82701 - DNA, 1704 bp, Homo sapiens
ttcccgccccgcttccccttccctcccctcccctccccgcaccgcgcgctagcccggggcggctccgcagcccgccgggagctctgaccgaggcgcctcgctggggcggggaccttgccttgcccggggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggaagtaaaaagaaagaaaaggaacggccagaaatttctcctccatctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggccttccttctggaacgccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagcctaagatgacagatgaagagattatggagaaattaagaactatcgtgagcataggtgaccctaagaaaaaatatacaagatatgaaaaaattggacaaggggcttctggtacagttttcactgctactgacgttgcactgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaagaaccctctcccgggatcctttaaagtcggcccgcaaggatcc

SEQ ID NO: 82702 - DNA, 515 bp, Homo sapiens
ggtctcttagaatccattgattagaccagtagcttttggtagtaccatgatgtttccatttgacttttcaaacatttttcagctgaccattaccagctttgttgggggtaaactcaagagagttacatcttttacacattgatttttccagattttgcaaatgtcactataaatggataatattttctaattgggagttgtggcaggggtagttattactgttttttgcttgttcgtgctattttttactttgttactaattgtattttttccaattccaggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggtaaatagcgcttctggctttcagag

SEQ ID NO: 82703 - DNA, 2122 bp, Homo sapiens
ttcccgccccgcttccccttccctcccctcccctccccgcaccgcgcgctagcccggggcggctccgcagcccgccgggagctctgaccgaggcgcctcgctggggcggggaccttgccttgcccggggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggaagtaaaaagaaagaaaaggaacggccagaaatttctcctccatctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggccttccttctggaacgccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagcctaagatgacagatgaagagattatggagaaattaagaactatcgtgagcataggtgaccctaagaaaaaatatacaagatatgaaaaaattggacaaggggcttctggtacagttttcactgctactgacgttgcactgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcgaaaagacaagtatgacttttatatgaaccccttctttaggggtccagaaggatttgtgggactgaattcactaggcttaggtctttcaggaaacaggctatcaggggcatttatcatgtgtgagattggattctacttgggtgatttggtggatagacccatgaatggcccctgggggttttcaatcttggattggaggtgggggtttcagagtgttgccacgtctagctcctctccc

SEQ ID NO: 82704 - DNA, 1999 bp, Homo sapiens
  misc_feature (4)..(4): n is a, c, g, or t
  misc_feature (76)..(76): n is a, c, g, or t
cccnttattgccccgcgaccggttcatacgaaatcaatttacacacggtctgtaattgaccctgttcctgcaccanttggtgattcaccatctttagcactggaggcaaagaccctttgtcagccaatcacagtttgaaacctttgccctctgttccagaagagaaaaagcccaggcataaaatcatctccatattctcaggcacagagaaaggaagtaaaaagaaagaaaaggaacggccagaaatttctcctccatctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggccttccttctggaacgccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagcctaagatgacagatgaagagattatggagaaattaagaactatcgtgagcataggtgaccctaagaaaaaatatacaagatatgaaaaaattggacaaggggcttctggtacagttttcactgctactgacgttgcactgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcgaaaagacaagtatgacttttatatgaaccccttctttaggggtccagaaggatttgtgggactgaattcactaggcttaggtctttcaggaaacaggctatcaggggcatttatcatgtgtgagattggattctacttgggtgatttggtggatagacccatgaatggcccctgggggttttcaatcttggattggaggtgggggtttcagagtgttgccacgtctagctcctctccc

SEQ ID NO: 82705 - DNA, 131 bp, Homo sapiens
aatgtaggaagctgggacatcattctgcctaccacactattattcttattaaatttatataatctgattttgtgccactttcctgcccctcagggttttaaacattcttagaaggtcaccttttcctctat

SEQ ID NO: 82706 - DNA, 629 bp, Homo sapiens
gtctagacgggtcacttacatggttggcagtgcatattggctgctgagtgtgatgcctatctgacctctccatgttacctggagtgctcacaacgtggtagtttgtcccaagacacacaggcaaatactacaaagcttcttaggacctagccttggaggtcctagaatacgacttctgctgcatcctattggaaaagcaagtcattgtgaccagcacagattcaagaaatgggagattcgactctacctgtcaatgtaaacagcagcatgtgcatgcagggaggaaagaaattgagggcatcatcttgaagactatcatatcacaccattattccaactagtgaacattatgttttagatgggtagtactagctactcatctgtcccccagaaacccaagctaagcatggacatattgaagagaatgtcagcaccattaaaaaaactctagaaaaatcacatgtgatgactgaggttaattcagtctgtcaattacatcagtataattgccttcttgtaaccctaagtatggtgaagcagaattgaattctacaaaagtctttcatctgttttcctatggaataattaacaaacccaataaatgtataaatagcatgaaaaaaaaaaaa

SEQ ID NO: 82707 - DNA, 430 bp, Homo sapiens
  misc_feature (2)..(2): n is a, c, g, or t
tntacaggatcttcaaacacgcaatctcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcggtgtttgcaaacaccggaaatctcaaccctcttttggtgatgggaaccaaaatgatggccctcagcagggaccaccccaaacaatgaggtcagcagaaaacaaggtaccaaccaactcc

SEQ ID NO: 82708 - DNA, 384 bp, Homo sapiens
agtgtagaggtttccccaactgtctgatgattcttagatccctatttatgtttaaggataagaaatcaaaattgggtttaaagctctaagcccatgagtggtgctgttgactgaacttcaccataaggtgatttggccaagccatttcattaaggaatctctgatatattttcagatctttcctcctgggctggccagattctgcagagaacatcttccagttgtctgatgcatagtgagggcctggccagcattctaggacctgagggggcaggtagagaggagtcgcagcacccagggtgcacacatgttcgctgaatcccctttgtcagtaggactaatgtctgctgtgtcctgtgcctcccaattcagagacgcactatt

SEQ ID NO: 82709 - DNA, 364 bp, Homo sapiens
tccaggtagaatcatgttttcttttaattgaatacttaactcacaatgtttcctgttttgcagctgctctgctaataattaggttcccacctctcaagatcattaggagcttcttttccaattcctctgttttgcatgcattggaaggtaagtttccttgtaaaccagattttggactctgcaggctttgcaaatggcctttttaccctcatgtatattgcattttctttggatagtctcatggattctcaaggatattgtattcctgtattttaccattcatgagtttagaagtgtgtttactttcctgagttttcattttctttttcttctgtcatatgtaatttacagagcaaatacctac

SEQ ID NO: 82710 - DNA, 385 bp, Homo sapiens
tttactatctactggtgcgtaacttggggtctttccagggttagcagcctcctaagagttttcctgtctgaattggaagactgtctcatccttggttctggggtccaaatctttcatcagcaattcctcagtgtctttactcgtattatctcattctgccttctctgcaggaaggtggtaggggagaagggacagaaggaagaaagagaaccatttatgtagcacctccagtgtctagcactggactttgattagaaaaagtaatcaataaacatatgtggaatgaattgcattatagagttcctcgtaagatttctccctatttcatactccccgcttccaccctccaacctcccccaaataggaatctctttgagaacaggga

SEQ ID NO: 82711 - DNA, 225 bp, Homo sapiens
aactgtcacttcgtatcaggcccagaaaccttaagactgtaggcaaaatctatagtctgccttggtttggcttcccagcctcaggaggttgttaaaatcggagtgatttttttcttgtgtgatcaatgtagagagaagcagccatgtttctgaagaaaagctgcaatactcctgttattagactggagccctgtgcactgtttccaagctcctcaattcttccag

SEQ ID NO: 82712 - DNA, 103 bp, Homo sapiens
ctgtgatttcgtttagattatttatgttgaaattttttttttttttgcagtgcacagaagcctcaccaatacatgttttatttcagataccatgatagtgtca

SEQ ID NO: 82713 - DNA, 527 bp, Homo sapiens
accacatccacctcattttacagatgagaaactgaggcccgaagagactaagtccaaaggtcctcactaacaagtaggagcaagaaccctatttccagttcagggttttgttgtcaattacgtgttatttgtttatttaaaaaagagaaaaacctattctagtatctcaaaatgcttctacatagttgggaagaaaatgaatacctagaataagtaaatatttaatgaaagctaaatactgaaaacaaattaatgtcatccctaccctgcagtaaacatgctgaaagggctcctaggacagaaataagtagaatcatagccacacttcacagcatctagtagaagttaggtgccccattgctaacatcaccaaacaccaccaccagagtgccttctttttttttttttttttttgagatggagtcttgcattgtcacccaggctggagtgcagtggcactatctcggctcactgcaacctccgcctcccaggttcaagcgtttcttctgcctcagtctcctgagtag

SEQ ID NO: 82714 - DNA, 388 bp, Homo sapiens
aaatattgtatgttctgtggctttagtgctttggctgttgtttgtccctatgtggggagggtactttttctgccaaatccctccttcccttaccccaagtctcgaattccaagttccatttgtgttccagagttccctcaaaggctacctgctccaaaactatcttcatggttttgcacaacgcctagttctctcttctgaactcccatagctttttcccttcaactttttttttcttttttttgagacggagtcttgttctgtcgcccaggttggagtgcaaaggcgtgatcttagctcactgcagcctctgcctctcgggttcaagcgattcttctgcctcagcctcccaagtagctggctaatttttgtatttttagtagagacg

SEQ ID NO: 82715 - DNA, 856 bp, Homo sapiens
ggttctcatttcaggtcatttgaggcagcagatactcgggtgctaaaaatccctccaaacatctcaacattttttccccctcgggatcagtatggtgtcacgggaagaagtttaaagaatgaatagcatgtccagccatcccactgtgtgtctatagatgccaggccagcccaggagatgcactttcagattcctgatggcagccgctataagcaaaagtttcctggaggtgctcctctctctccaatcagcttcccagttctacaaaactggacttcaggttgtcacatatagaggttttcaaccactatcagctttggtcttccatggtattcagcaaagaactagcccacatattgtagtgaagactcccttagatcacatgacagtatttgagactggagatgccatgtagtgagtttgttttttttttttgaaatgagaagcgagacatcaactcacgggtaaagtacccatagccgttattttttccctccattcttccctctctcccttcaccccagctaaagacagaatttgacttcaaattaatttgaggccaatgtttttcatactgctagtgctgagagaagaaaggcaacggcttctcacccgtgttaacttatactttctcttaacccaaggaatcaatactgtatcacttagtcctgggaagagggagtaaaaggtagttgcctgaatgaacctttggcattcatttatctacagaaccctccaaaaacaaaattcctattgaaaggaaacctgcacagcaccagcttgtaccttgcacctgttctgttaaagtcattcacagagcagaatacattagaatagataaaatgttttggtgtgc

SEQ ID NO: 82716 - DNA, 272 bp, Homo sapiens
acaaatgaggcttttgtaggggttgagattcaggaatttagaggaattttagaaatcttctcttagccggccggacatggtggctcacgcctgtaatcccagcactttgggaggccaaggtgggcggatcacctgaggtcgggagttcgagaccagcctgaccaacatggagagaccccgtctctactaaaaacacaaaattagccaggcgtggtggcacatgcctgtaatcccagctactagggaggctgaggcaggagaattgcttgaac

SEQ ID NO: 82717 - DNA, 479 bp, Homo sapiens
caaagctgctgtgctgcaggagacagcagaccagaactaagaaaccaaacctctcctcttgcaccttctatttacaaaatgtcagtgctagctggcgaaggaaaaaaacctataaagggcctaagtccattttttttcacagagcaatccaaaagggtaaaattggagctagaggaaataagtcagtcatccgcacagatcatcccaaccctttgactactcaccttccatatgtactcttctgcacgcatttgtccggtacaatggcaacgcaactctgtatttctgcttaacaagatacagctttctttcttgcaagtgaagaagtgttcatcctctctctaaactgaggagatgaacagccccaagggtcattgtattcatcactggctatataatcaccccagaaattcagtcacagtttgttacctaaagactgaattataaaacctaacatgtaataacttgtgaataaggta

SEQ ID NO: 82718 - DNA, 350 bp, Homo sapiens
ggctataagtcaggggtggggcggggggtggttgggggtgggggctaccgcagggtggggaaccagctaaggctgaaagtttccttgaaaaaatcagcttttgagaaagttcctgttgatgcaaagttactcaacactttctcttgcccagcccagaactacttcctcattctcccagcttggtatctgtaaagacaatcatcctttttgggtaaaggtaaaagagaaaccctagaggaagtacttgctgagaagacaaggttatcccattttacagggaaaagtgttaaaatctgtattgttaacagtagtaacgataacaataacaataaaggtatttccacacaatt

SEQ ID NO: 82719 - DNA, 363 bp, Homo sapiens
gtggggccaggaggctaattaacaacaggatttgtgattcatgtcaccaatacctgctcatcagtaatgcaaagcctgaagtcagttagaaaagtaggcaaaggaaacggaggctgcagggccgcacttctcacttaacagaaagaatgccgtcctgttgggcatggtaatatgtccagctaaaaccatattttgcaactctccttgatgatagagccatgtgacagttttaatcagcaaaatgtaatgacaaattgctaggtgtggcctccaagaaagcaccttgaaaggaaggtagattcagctggcacatgccttatactgtttgcctttctcctctcctcacctgggatatagatgcaa

SEQ ID NO: 82720 - DNA, 782 bp, Homo sapiens
atagtctgctctgagaaaagagccaagttcagggcagagactaccttcctgggtaccccccaagaaggagtcttgatcacttctctaaacatgccctggatgttcccagagctcatgaaaacgctgctctccagtggtgctagcagctctgatgaaggctaagtccaagctctgaattcaggagagcagagctgcctcctgctcccaccaccgtggttctcaggcagtaatggttctattattggccatgtcaattggagcaaccatttggaaagtcatttggcaacatctcccaaagctgaatatacatgaagcctaggagccaggaattccacttccaggatatgcccaatagaaatgaatacatatgttcaccaaaaggcgtgtcctagaatgtttataattgtgaacagaccaaagctagaaactatccaagtgtccatcaacaatggagtgggaaataaaatgtctcttcgtacaatggaatctacatagcaatgagaacaaagaacttacaaaagtacacagcaacatggatgaaattcacaagcataattccgaacaaaaaatgccatgtaccaaaaagcttatagcatatgactccatttatgtacagtagaaaaacaggcaaaacagctagcctgttagaagtcagaatggtggttaccctttgaggggctgttcctagatggggactcatggggtaatgttcattccatgtcttgaactgtgcactgattacactggtgtgtttagcttgtgaaatgtatccacctatacac

SEQ ID NO: 82721 - DNA, 462 bp, Homo sapiens
aaattgtgtcctcaatctcttttctccaaagaaaatgttctaaaattgctgggtaaattgtctactcagatatccacattggagtgtaactttggccatatcgtgtggactgagggcatgcggagactcgcgatgctagtgggaagggcattggaatttggtgaacctgtgctgctggttggagacactgggtaaagatctgtgacagtgactcatgagggttcatttcaattccataggattacttgagttatcactgaagaactcatgaaagtattaatccccccttctttcctccttcctcttttttcttttttttttttttttttaagaagagactaagagtgggtcgggggctgggggagggatagcattaggagaaatacctaatgtaaatcacgagttgaggggtgcagcaaaccaacatggcacatgtatacctatgtaataagcctgcacatt

SEQ ID NO: 82722 - DNA, 435 bp, Homo sapiens
aaattgtgtcctcaatctcttttctccaaagaaaatgttctaaaattgctgggtaaattgtctactcagatatccacattggagtgtaactttggccatatcgtgtggactgagggcatgcggagactcgcgatgctagtgggaagggcattggaatttggtgaacctgtgctgctggttggagacactgggtaaagatctgtgacagtgactcatgagggttcatttcaattccataggattacttgagttctgcacactccgctgctttcctcctacctcatctggcgtcctttctattcttctttttagcttgttttgtctgtcgccttcgtgtcctattggtaattcgcccctgttcctctgtggtgtcctgcgcttcttctcttcttcctacctgcgccttctataaccgaactttttcaggcctgtttt

SEQ ID NO: 82723 - DNA, 3736 bp, Homo sapiens
  misc_feature (2279)..(2279): n is a, c, g, or t
cccccacttgcagcggcgctcgggagccgggcggctgggccaggcggcgccttcggggctgctgcgcgcccgcgcctagagctgccgccccagggagcccgccacggccgcgccccgggcacgctcggcggcgcccaacgatgaccgctccctggcggcgcctccggagtctggtttgggaatactgggccgggctcctcgtgtgcgccttctggatcccggactcgcgcgggatgccccacgtcatccggatcggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaaggcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggccatggccatgggcatgatgactgagtactaccacttcatcttcaccactctggatctctacgctttagacctggagccctaccgctactcaggcgtgaacctgacaggattccggattctcaatgtggacaacccacacgtctcggccattgtggagaagtggtccatggagcggctgcaggcagctccccgggccgagtctggcctgctggatggagtgatgatgactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctggaggagcccttcgtcatgtttcggaaatcagacaggacgctatacgggaatgaccggttcgagggctactgcatcgacctgctaaaggagctggcccacatccttggtttctcctatgagatccggctggtggaggacggcaagtacggggcacaggatgacaagggccagtggaacggcatggtcaaggagctcatcgaccacaaggcagatctggccgtggcccccctgaccatcacccatgttcgagagaaggccatcgacttctccaagcccttcatgacacttggtgtgagcatcctgtatcgaaagcccaatggcaccaaccccagcgtcttctccttcctcaatcccctgtccccagacatctggatgtatgttctcctcgcctacctgggggtcagctgtgtcctcttcgtcatcgccaggttcagcccttatgagtggtacgatgctcacccctgcaaccctggctccgaggtggtggaaaataacttcactctgcttaacagcttctggtttggaatgggatccctgatgcagcaagggtctgagctgatgcccaaagccctgtccacacgcatcattggtggcatctggtggttcttcacgctcatcatcatctcttcctacacggccaacctggctgcctttctgaccgtggagcgcatggaatcacccattgactctgctgatgacctggccaagcaaaccaaaatcgagtatggggctgtcaaggatggggccaccatgaccttcttcaagaaatccaagatctccaccttcgagaagatgtgggccttcatgagcagnaagccatcggcgctggtgaagaacaacgaggagggcatccagagggccctgacggccgactacgcgctgctcatggagtccaccaccatcgagtacgtcacgcagaggaactgcaacctcacccagatcgggggcctcattgactccaagggctacggcatcggcacgcccatgggctccccataccgggacaagatcaccatcgccatcctgcagcttcaggaggaggacaagctgcatatcatgaaggagaagtggtggcggggcagcgggtgtcctgaggaggaaaacaaagaggccagtgccctggggatccagaagatcgggggcatcttcattgtcctggccgccgggctggtcctctctgtgctggtggccgtgggcgagtttgtgtacaagctccgcaaaacagcagagagagagcagcgttccttctgcagcaccgtggccgatgagatccgtttctcccttacctgccagcgtcgagtcaagcacaagcctcagcctcccatgatggtcaagactgacgccgtcatcaacatgcacacattcaatgaccgccggcttcccggcaaggacagcatggcctgcagcacatccttagcccctgtgttcccctaggcacaactggggtggggacctcaggcctgggggctgggcagaggaaagcaaaggagattggaaggaacgtcccctgtacccgcactgggcttggggaccagagctgccacctgcctgttgggccaggagcctcctgcccttacctgccaggaagccagcaggctctcaggccagctgcttgggcttcatcctcctcagatcttctgtgggtttctaaagctgccagccgagatagccaaggccaaaggaagcacatgcctctctcaggccaaactcacctgcccctcaactctcctccagagtcagaagtttctgccgcagccctgcagagggcacagaaaatggaagacagctcttatattgccatttcttccacaagagcccaggcctcctacagcttgaccgtgaggccagagacacaacttcggcgccttaaggatgttctagcatggctgccaatgggagctcatggtgagggatacccatcccatatgcctgggcagaaggaagacttcatccctctggggctgttcacgtggtcctaatcttctgaacttggcgctgcccctggcagcccctgttctggcagagttgaagacagagctacacaggggaaaagaggagtttggggtatgggagagaagagaatgcacaaacagaggccgccattttggattcttatggacaatgacccagtggttcctaatcctctaggaggtctctaagaatataagtgggggagtggccacagaaaattcttctccactttctagccagaggagagaggaccccctgaatttctcacaaaggatgcccaaagatgcagccggtatttg

SEQ ID NO: 82724 - DNA, 2759 bp, Homo sapiens
  misc_feature (2279)..(2279): n is a, c, g, or t
cccccacttgcagcggcgctcgggagccgggcggctgggccaggcggcgccttcggggctgctgcgcgcccgcgcctagagctgccgccccagggagcccgccacggccgcgccccgggcacgctcggcggcgcccaacgatgaccgctccctggcggcgcctccggagtctggtttgggaatactgggccgggctcctcgtgtgcgccttctggatcccggactcgcgcgggatgccccacgtcatccggatcggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaaggcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggccatggccatgggcatgatgactgagtactaccacttcatcttcaccactctggatctctacgctttagacctggagccctaccgctactcaggcgtgaacctgacaggattccggattctcaatgtggacaacccacacgtctcggccattgtggagaagtggtccatggagcggctgcaggcagctccccgggccgagtctggcctgctggatggagtgatgatgactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctggaggagcccttcgtcatgtttcggaaatcagacaggacgctatacgggaatgaccggttcgagggctactgcatcgacctgctaaaggagctggcccacatccttggtttctcctatgagatccggctggtggaggacggcaagtacggggcacaggatgacaagggccagtggaacggcatggtcaaggagctcatcgaccacaaggcagatctggccgtggcccccctgaccatcacccatgttcgagagaaggccatcgacttctccaagcccttcatgacacttggtgtgagcatcctgtatcgaaagcccaatggcaccaaccccagcgtcttctccttcctcaatcccctgtccccagacatctggatgtatgttctcctcgcctacctgggggtcagctgtgtcctcttcgtcatcgccaggttcagcccttatgagtggtacgatgctcacccctgcaaccctggctccgaggtggtggaaaataacttcactctgcttaacagcttctggtttggaatgggatccctgatgcagcaagggtctgagctgatgcccaaagccctgtccacacgcatcattggtggcatctggtggttcttcacgctcatcatcatctcttcctacacggccaacctggctgcctttctgaccgtggagcgcatggaatcacccattgactctgctgatgacctggccaagcaaaccaaaatcgagtatggggctgtcaaggatggggccaccatgaccttcttcaagaaatccaagatctccaccttcgagaagatgtgggccttcatgagcagnaagccatcggcgctggtgaagaacaacgaggagggcatccagagggccctgacggccgactacgcgctgctcatggagtccaccaccatcgagtacgtcacgcagaggaactgcaacctcacccagatcgggggcctcattgactccaagggctacggcatcggcacgcccatgggctccccataccgggacaagatcaccatcgccatcctgcagcttcaggaggaggacaagctgcatatcatgaaggagaagtggtggcggggcagcgggtgtcctgaggaggaaaacaaagaggccagtgccctggggatccagaagatcgggggcatcttcattgtcctggccgccgggctggtcctctctgtgctggtggccgtgggcgagtttgtgtacaagctccgcaaaacagcagagagagagcaggtaagccttagagcttggagcctgcacaggatgggaaatggagattcgcgctga

SEQ ID NO: 82725 - DNA, 1773 bp, Homo sapiens
cccccacttgcagcggcgctcgggagccgggcggctgggccaggcggcgccttcggggctgctgcgcgcccgcgcctagagctgccgccccagggagcccgccacggccgcgccccgggcacgctcggcggcgcccaacgatgaccgctccctggcggcgcctccggagtctggtttgggaatactgggccgggctcctcgtgtgcgccttctggatcccggactcgcgcgggatgccccacgtcatccggatcggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaaggcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggccatggccatgggcatgatgactgagtactaccacttcatcttcaccactctggatctctacgctttagacctggagccctaccgctactcaggcgtgaacctgacaggattccggattctcaatgtggacaacccacacgtctcggccattgtggagaagtggtccatggagcggctgcaggcagctccccgggccgagtctggcctgctggatggagtgatgatgactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctgttcccaggcaaaagcctttcccacaagtcaccccagctgtggtgggtgctgtggccacacctcgagagcccagcaggtgctgggagcctgtacacatgccgcattctatagtggcccttccgagagccgtcagccactgccacaccccctgcctggaatcacaccccatcttctctctattccccaactgaatagcaccgccttctcctgacctgtttcaaaccaagaagcaactctgggggcctcccatgggctctctgcacctttgagctcatgcgggggcaggaggacagacccaggctgctga

SEQ ID NO: 82726 - DNA, 2103 bp, Homo sapiens
cccccacttgcagcggcgctcgggagccgggcggctgggccaggcggcgccttcggggctgctgcgcgcccgcgcctagagctgccgccccagggagcccgccacggccgcgccccgggcacgctcggcggcgcccaacgatgaccgctccctggcggcgcctccggagtctggtttgggaatactgggccgggctcctcgtgtgcgccttctggatcccggactcgcgcgggatgccccacgtcatccggatcggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaaggcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggccatggccatgggcatgatgactgagtactaccacttcatcttcaccactctggatctctacgctttagacctggagccctaccgctactcaggcgtgaacctgacaggattccggattctcaatgtggacaacccacacgtctcggccattgtggagaagtggtccatggagcggctgcaggcagctccccgggccgagtctggcctgctggatggagtgatgatgactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctggtaagagcctgcagcccctgcaggaaggactgtccgacctgggggtggggtggccgttcgggctggagagtcccctctatcccccccacccagaagatggaggctgcaggtaggtggagacttttagagtcagcaggaagttctcagagagcagctggagcgcagcagcgctgctcgctgccacgggcggaagccgctgcgtttttgtgtctcactcccactcactccccaagtccttgatgtctgagtaggaaccatgctggatggtggaattaagggggtttgacagcccattgcaacctgagtgaggattcgcctctcccaccccagttcccaggcaaaagcctttcccacaagtcaccccagctgtggtgggtgctgtggccacacctcgagagcccagcaggtgctgggagcctgtacacatgccgcattctatagtggcccttccgagagccgtcagccactgccacaccccctgcctggaatcacaccccatcttctctctattccccaactgaatagcaccgccttctcctgacctgtttcaaaccaagaagcaactctgggggcctcccatgggctctctgcacctttgagctcatgcgggggcaggaggacagacccaggctgctga

SEQ ID NO: 82727 - DNA, 459 bp, Homo sapiens
gtgagtgccccacagcccccaccagggttgtctccccgggactgtgggccctgtagagcagcagagtggtctgggagtcaggaaggattgattctcatccatgtgacctcaggcaagttgcctcatgtctccgagcctcagtttcccgtgtgaaaatgggctccataggaccaaacttatggcatgattgaggggcatacatcttgggcatgtggtaagtgctcagcagctggtcagcattgccagcaagatgcagcgtgggcttgaaagtacaacagatgagggtgtttgcttcctcgctgtatgaccttgggcgagctggagagccttgctgagcctcagtcacctcatctgtgaaatgggtatatgaagcataacctacctcgtgggcatgtgagatgaagttagacattgcgtggaaagtgcttagtgcaggaggagggtcaatacataataatc

SEQ ID NO: 82728 - DNA, 624 bp, Homo sapiens
ggtgccccgcctttctctgggacacagttgggggctggcttctgagggattcctttctcccctctttgtgtggccccagccagggcggtgggcagtcctggtgtagagcacaagcctctccaccctagagaaatgcctctgtaccacggctaccatgtggaaccttaacttgcagaaggcttgttaacaattgttttgagagagatggctggtcatgccacagctgctggggactccgcctactccagccctcttgggacacactgtgggatttgtggcccttccccagaggaattgtggagactgtcccatggaacaaaccctcaggcaccagcacagggctctgggtgactcagtaaaactaacgtttgtctctgacaagatcagctgtaggctcaccggccagagaagaccactgtgagcattttgccgtatatcctgccctgccatttgttcactttttaaactaaaataggaacatccgacacacaccgtttgcatcgtcttctcccttgatattttaagcattttcccatgtcatgagtttctcagaaacatgtttttaacaattgtactatttagtcattgtccatttactataatttatctgaccatttccctact

SEQ ID NO: 82729 - DNA, 543 bp, Homo sapiens
ggtgccccgcctttctctgggacacagttgggggctggcttctgagggattcctttctcccctctttgtgtggccccagccagggcggtgggcagtcctggtgtagagcacaagcctctccaccctagagaaatgcctctgtaccacggctaccatgtggaaccttaacttgcagaaggcttgttaacaattgttttgagagagatggctggtcatgccacagctgctggggactccgcctactccagccctcttgggacacactgtgggatttgtggcccttccccagaggaattgtggggcctctcttggcaccttgaggtagttgctcgtttcctccaccgggccttatctttcccttctgggcgtttccagccctgtgttttcacactcagggctctggctgagattctgtcagttggtgctttcatctctgcacagtcatggaggccctaagaccttgtcttggatctgggaacttctctcagaatcctcaaacatcaccctggctgtgcatgggagctcacacctgtaatcctaggg

SEQ ID NO: 82730 - DNA, 505 bp, Homo sapiens
cagcctagccaaatggcaaaaccccgtttctactaaaaatacaaaaattagctgggcgtggtggcgagcacctgcaatcccagctactcgggaggctaaggcaggagaatcccttgaacctgggaagcggaggttgcagtgggccgagattgtgccactgcactccaccctgggcaagagtgagactgagtctcaaaaacaaaaaaaaaaaacacaggcctcagcatcgcctggacctgttcttgcttggggcatcccgtcggtcaccaaccatgacagcgaggcgggcctggcctgtgctccaccggagggggcttcttgcacagatgacctgctcatttcagcccctccagaatcttctggcaggcgcagagcaacaggacgtccattttacagacgaggaaaccgagacacagggaaggttgccatctgcaacccagcccggtttttatcttgtttttctgtgttttaactttttatttagacttacagtttgaaacagtgc

SEQ ID NO: 82731 - DNA, 376 bp, Homo sapiens
tagacacattgtttgctgccatttcattcagcagctgcgttattcataagatcactttataatgacatacttttccatcttactgttttataattattaaatggttcccctgatattgctccattttttttttttttcaggagaaacattctcaggttagtactgttaatccctccttacgtgtttaattagattatagagtgttggttttttccttccttataaaatcttacgtagagttttctatactgatgtgtctggtcaacctgtgcttcctgacttagctgagtcttcctgcagtctttatggggtttcataaagtgagcaggtaccatgctcacttagttataacttccctgaggtctagaaatctcct

SEQ ID NO: 82732 - DNA, 665 bp, Homo sapiens
caggccacacttgctgcatggggttgctctcggccccactcttggtgcacagcgagtcactgtgggttcattagcatctggttatgagacagtaactgctcctttggaggggctcgtggagaccatgcaggagggcacggtcttgaggtcatgccgtccagagcacacctgaggataggccaggacgggctgcacgctgtaggtaaaattcctccagcaagctcttcactggcattgaggagttccctgagtgcggtcatctggaaggcagctgtaacaggcactgcagtctctccctgggtgggtaccagagaggagcataggggagcataaccgatttaaagagagggctttcctgtggtgaggtaagagattagctggtcattatcatagagccccctctgcctttgtgcagatgggctgtgggaatcctggggttccgttgggtcctttgtcacctcactgaaggcatgtaagctgagctggccagaccgtgagctgatcctgccacttgaacagcatcaagcctgcctctggattcttctgtgcatggcacttgtctgagcacctcacgcacagagaactggacttcagagtttacagaaataagctgtatggttcattttcatgcctgcttgccaataaacatatctgagctgaacctc

SEQ ID NO: 82733 - DNA, 162 bp, Homo sapiens
agccctacatcccactgcagatgctacagctctggaagctctcggagcctgcagagcatcctctcgtgcgggccatggtgatcagcgatgctttcagagctggaatccatgagggcagctcggaagatgttgtaacagaagaagcacaggatgagggctgat

SEQ ID NO: 82734 - DNA, 692 bp, Homo sapiens
cccggtctagtagggagggcttcctggagtagggacagccacattcatcccggctgtggactgaactgtgtccccttcagatgtcatatgttgaagcccttgcctccactgtgactgcatttggagactgggcctatcaggagataagagatcacatggagacacagcaagaaggcagctgtctgcagccaggaagagagccctcagcagaacctgcgcctgccagcaccatggtcttggactcccagtctccagaactatgagaaactgtaagtcagagttaagactggagcccaggccatctccctccaccacccacacctgacatccgcacactgcgcttcctgcatggtggacagtgcctgcctgctcacaactgggaccactgcctcctctgcttctctgtagccctggccctagctcgtggaaggagcaacagggccatatttgagtttcagagcactgctcaggggggcagaaggcagggtcagattcttctggaagaggtcggaggtttcccagccagaacaaaactgggatgagaagctggggttcctcccacccctctccaggacctgtgaatgtccctcccctgtggagctggaaagccagcccgaaggcacctgccccgtgggaggacacacccctgagcctggatgcctcatctcctgcagctttggaattctagcccc

SEQ ID NO: 82735 - DNA, 469 bp, Homo sapiens
gggctgacaaggaggcaacccctagccctggacccttcagctaagttcaactccaggtcaagtcaggggcccccagcagctcaggggcacaggatccacaaggaagaaattccaggatgttgccagaagctaacaacagttcccagctgttcccagtcgcctcttgccattgaagtagtttggagtgggggtcttcacacagacacagcagaaggaaggtcaaatgaatgactgtgcctctgggccagggtggaggacaggccagtgagaacagaagcctctttgttattggcagctcctgcacatggccccctagacccttgacggagacctccctctccccccagatcttggggaccttgacatcggtggtatttatgcagctctcctcatgtcatcgtggtaaaactgctgcttgcggcttgcctacggcctggagcctcgctctgcaattccttttggagcacat

SEQ ID NO: 82736 - DNA, 480 bp, Homo sapiens
aggaattcaagcctgcagcagaaatttgcataagtaacaaggagccaaatgccaatgaccaagacaaaagggaaaatgtgtccaggacatgtcagagacattcccagcagcccctcccatcacagtcttggaggcctaggagctctgggaataattttttaaatgtttgtaaaaaataagaaaaagtttaaattgaaagtacatttagaaaaataaaagcagactataaaaagcatagaactgataaatcctaaaatggtttccttgggtaaaataaaaataatacataaactattttagactagctaatataatggaaaaatgagggaaacttttattaatcacaaaatctggaagggtaaagggaatgtgattataagaaagtaattggaaaatgattataaaaggatcaatttacaactgtatgctaatatatatgaaaatatagtgcaataaatgattttctaagaaaatataaat

SEQ ID NO: 82737 - DNA, 927 bp, Homo sapiens
agaacagtgggcccaggggaccggcacactcagcatgcgaggacccgcaccagtgccggtctctgagttccttcagtatttattgatcattatttttactgtcttggcgaggcgagtgtagcagggcaacaggtggcgagaaggtcagcagggaaacgtgagcaaaggaatctgtatcatgaataagttcaaggaaaggtactgtgcctggatgtgcacataggctagatttatgtttcactttacacaaatatctaactagcagagagcaacaaagcagtattgctgccagcatatctcgcctccagccacagggcggttttctcctatctcagaatagaacgaatgggaatggtcgactttacactaagacattccattcccagggacgagcaggagacagaagccttcatcttatctcaactgcaaagaggcctccctctttcactactcctcctcagcacagaccctttacaggtgtcgggctgggggatgtaaggtctttcctttcccacgaggccatatctcaggctgtctcagttgggggaaacctggacaatacccaggcttttctgggcaggggtccctgcggccttccgcagtgcattgtgtctctggttaatcgagaatggagaatggcgatggcttttaccaagcatactgcctgcaaacatattgttaacaaggcacatcctgcacagccctaaatccattaaaccttgattcaatatagcacatgtttctgggggcacagagttggggctaaatttacagattaacagcatctcaaagcagaacaatttttcttagtacagatcaaaatggagtttcttatgtcttccttttctacgtagacacaggaacaatctgatctctttttccccacacttcctatatgttaatgtattttaattgtctgttagcttt

SEQ ID NO: 82738 - DNA, 359 bp, Homo sapiens
agagcttttgatttaggcagttctgagtttatattccaggtaactaggtgatttggctcgttcaccttacatctctgggcctccattttataatctgtaaaatagggttattgtgaaaattagaggtaatacctttaataaactattgtgcctggcacataataaattaaattgcacactatagctggaattattagatgttattgacttaaatcattataattttgctgtgagttattttaacagcaatgatgatggcttgtcatgcctcctgtattcttttgttttatgaccagtggaacatatctggtgaatagctcacttttttaattgatgtatttctgtgttttgttttgttt

SEQ ID NO: 82739 - DNA, 501 bp, Homo sapiens
cctgtttttcaagaaaatcctgtcaacaaatctgccttttctcccttacatcattcatggctttccttttttctctaaaatcttaaatttccaccccagccaaactatataccaattgagcctctaacatcttcatgggtacatgactgctgctggcacagacctgctctaaaatcagtttcattccttcccctactgctctgctagcagcattcttctcttaaattcctttgttcatagcacctgcagctcacctcacatcctgtatgcttcatactgtccttgggactgagccaagcagaactggaactggatgctgtggtgacccagagcaaattacaaacttctcagagcctgttttctcacgggcaaaatgcagttaatgccagggcatggctgggaggtcaaatgaggtgacggaggtaagtaatgcctgacagtgagaagctccatgatggttagctctattctcccacatgcctgcaccctgagttgcttcag

SEQ ID NO: 82740 - DNA, 3629 bp, Homo sapiens
  misc_feature (2430)..(2431): n is a, c, g, or t
tccactgcccccaaacccgttgttattttggttgctttgtgtttgcccttcgcatgctgtgctttccggcctgtgtgtgtgtttcttctgttgttttgttttgctcttttggttttgtggtttttttggtttggtttgtgtcgcctgcagctgcaccgagcaacctcttcgccagcctggacgagacgctgctggcgcgggccgaggcgctggcggccgtggacatcgccgtgtcccagggcaagagccatcctttcaagccggacgccacgtaccacacgatgaacagcgtgccgtgcacgtcacacttccacggtgcctctggcgcaccaccaccaccaccaccaccaccaccaggcgctcgaacccggcgatctgctggaccacatctcctcgccgtcgctcgcgctcatggccggcgcgggcggcgcgggcgcggcggccggcggcggcggcgcccacgacggccgcggggggcggtggcggccgcggggcggcggcggcggcccgggcggcggcggccccgggggaggcggcggtggcggccgcggggggcggcggcggcggcccgggcggcgggctcctgggcggcgtccgcgcaccctcacccgcatatgcacagcctgggccacctgtcgcaccccgcggcggcggccgccatgaacatgccgtccgggctgccgcaccccgggctggtggcggcggcggcgcaccacggcgcggcagcggcagcggcggcggcggcggccgggcaggtggcagcggcatcggcggcggcggccgtggtgggcgcgagcgggcctggcgtccatctgcgactcggacacggacccgcgcgagctcgaggcgttcgcggagcgcttcaagcagcggcgcatcaagctgggcgtgacgcaggccgacgtgggctcggcgctggccaacctcaagatcccgggcgtgggctcactcagccagagcaccatctgcaggttcgagtcgctcacgctctcgcacaacaacatgatcgcgctcaagcccatcctgcaggcgtggctcgaggaggccgagggcgcccagcgcgagaaaatgaacaagcctgagctcttcaacggcggcgagaagaagcgcaagcggacttccatcgccgcgcccgagaagcgctccctcgaggcctacttcgccgtgcagccccggccctcgtccgagaagatcgccgccatcgccgagaaactggacctcaaaaagaacgtggtgcgggtgtggttttgcaaccagagacagaagcagaagcggatgaaattctctgccacttactgagggggctgggaggtgtcgggcgggacagaatggggagctgaggaggcatttttggggggctttcctctgcttgcctcccctcggatttggagtgtccgttatcctgcctgcatttggggagtcccttctcgctctctttcctccacccattctctgattttcctgcctttgctgtcccctagccttagaggactggggtgctgggtgtggggattggagtatagggtaggggagaagggggggagcattcgggggagtggggagtggggggaaggaaagcggagacccgagcaggggttttaaggagcaggatggttctggggtttgggtggggggagacgcgggaagggtaggaaaatggactgtttctgaccagagacacttacctaaatatcctggggaccaaggaactatgtacaaaaacaaacctaccaaccaccaaaaactagacaaataaagacaaactaaaacaaaacagaacaaaagcaaaggaaaatgctttagaaattttaactccggggagccataatctgcaacttcattttcccccatagaagagaaaaaagagcaccaccattattaccacctccccaaccctacacgcacgaactgagtcgaaaaacgaaaaccaaacgagcgagaagttgaagttctgggtatcaaagctagttgttctgtctgcgtgtttaatttttccctctctcacctccaccccatccatatcctctttatttcctccgttccaatgagaggcctatggctgctctccaatcccgggaagtgagtgggagcacagctgaaaagagagggtcagggggaggctggctgcttgcttaggtggaatccaagttttcccgtggccctgcctatactctggtggcctggtcctgttggggtgggggtctttggagagaagggcatagtctttgagctactaaaaagcagaattccggagcttcgagatatcttattctaggaaaatgaaacaattttaacaacagttttttttcctcttatgtcgaagatctagttttagacaatttcaaaataagcttttcccactcatagaactttaacttgccctttcagttttatcttttttttagagagaggtttaaactactgattttnnctgttgattcaaatagactaatggggtgaaagttattaggagagatactctctcctgttttctccactgaacgagactcatcttgctcttctaggtcccgtttcttcctctcttggaggacatgaaattatagaaatgttgagaagtctgcctgctttcttttgcggtaggacttggctgtgagaaaatcacctaaatcccagaaaagaggaagacagatttaaagtgcccccacccccatttgtttcaaagaggtctgcatgttgggcgaaaacagaacaactgtgtttccttttacttgttcttattattcaagagtcatttattacaggggataaatgttgggtagcaagaactttaatttgcactaccagtctcccaaatagaaaatcatgtatagtatttcatagtaataatcaggtaccttacaagctgctggtggattttaaaaaattaagatagttgaaggtggttaggtaaaatgcctgctttgtgtacaagatactctttggatctctcgtagagatggtttgttaccatcctttaatcataactaaaacattgaaaacagaacaaatgagaaaagaaaaaaaacctgccgattaacaagactgaaatcatgcatgatctgaaaggtgtggaaagaaacacaattaggtctcactctggttaggcattatttatttaattatgttgtatatcattgtttgcagggcaaacattctatgcatttgaaactgagcactaaactgggctagctttctggtagaccgttttgtggctagtgcgatttcacagtctactgcctgtttccactgaaaacatttttgtcatattcttgtattcaaagaaaaaggaaaaaagattattgtaaatattttatttaatgcacacattcacacagtggtaacagactgccagtgttcatcctgaaatgtctcacggattgatctacctgtccatgtatgtctgctgagctttctccttggttatgttttttctcttttacctttctcctcccttacttctatcagaaccaattctatgcgccaaaatacaacagggggatgtgtcccagtacacttacaaataaaacataactgaaagaagagcagttttatgatttgggtgcgtttttgtgtttatactgggccaggtcctggtagaacctttcaacaaacaaccaaacaaaaaaaaa

SEQ ID NO: 82741 - DNA, 3836 bp, Homo sapiens
  misc_feature (2637)..(2638): n is a, c, g, or t
gcggggctagagctgtcggagaagcgggaccgcgaggccggcgcgcggcgctctgcgcggtcagagggagcgcctggcagcagcaggagcagcagcagcagcccgcggcggggccgccgccagccgccgcgaccgccgcggctgcagcctccgaagggaggccgggtgagccggcgtacgcactttcccgcggactttcggagtgtttgtggatatacatgccaagccgccacgatgatgtccatgaacagcaagcagcctcactttgccatgcatcccaccctccctgagcacaagtacccgtcgctgcactccagctccgaggccatccggcgggcctgcctgcccacgccgccgctgcaccgagcaacctcttcgccagcctggacgagacgctgctggcgcgggccgaggcgctggcggccgtggacatcgccgtgtcccagggcaagagccatcctttcaagccggacgccacgtaccacacgatgaacagcgtgccgtgcacgtcacacttccacggtgcctctggcgcaccaccaccaccaccaccaccaccaccaggcgctcgaacccggcgatctgctggaccacatctcctcgccgtcgctcgcgctcatggccggcgcgggcggcgcgggcgcggcggccggcggcggcggcgcccacgacggccgcggggggcggtggcggccgcggggcggcggcggcggcccgggcggcggcggccccgggggaggcggcggtggcggccgcggggggcggcggcggcggcccgggcggcgggctcctgggcggcgtccgcgcaccctcacccgcatatgcacagcctgggccacctgtcgcaccccgcggcggcggccgccatgaacatgccgtccgggctgccgcaccccgggctggtggcggcggcggcgcaccacggcgcggcagcggcagcggcggcggcggcggccgggcaggtggcagcggcatcggcggcggcggccgtggtgggcgcgagcgggcctggcgtccatctgcgactcggacacggacccgcgcgagctcgaggcgttcgcggagcgcttcaagcagcggcgcatcaagctgggcgtgacgcaggccgacgtgggctcggcgctggccaacctcaagatcccgggcgtgggctcactcagccagagcaccatctgcaggttcgagtcgctcacgctctcgcacaacaacatgatcgcgctcaagcccatcctgcaggcgtggctcgaggaggccgagggcgcccagcgcgagaaaatgaacaagcctgagctcttcaacggcggcgagaagaagcgcaagcggacttccatcgccgcgcccgagaagcgctccctcgaggcctacttcgccgtgcagccccggccctcgtccgagaagatcgccgccatcgccgagaaactggacctcaaaaagaacgtggtgcgggtgtggttttgcaaccagagacagaagcagaagcggatgaaattctctgccacttactgagggggctgggaggtgtcgggcgggacagaatggggagctgaggaggcatttttggggggctttcctctgcttgcctcccctcggatttggagtgtccgttatcctgcctgcatttggggagtcccttctcgctctctttcctccacccattctctgattttcctgcctttgctgtcccctagccttagaggactggggtgctgggtgtggggattggagtatagggtaggggagaagggggggagcattcgggggagtggggagtggggggaaggaaagcggagacccgagcaggggttttaaggagcaggatggttctggggtttgggtggggggagacgcgggaagggtaggaaaatggactgtttctgaccagagacacttacctaaatatcctggggaccaaggaactatgtacaaaaacaaacctaccaaccaccaaaaactagacaaataaagacaaactaaaacaaaacagaacaaaagcaaaggaaaatgctttagaaattttaactccggggagccataatctgcaacttcattttcccccatagaagagaaaaaagagcaccaccattattaccacctccccaaccctacacgcacgaactgagtcgaaaaacgaaaaccaaacgagcgagaagttgaagttctgggtatcaaagctagttgttctgtctgcgtgtttaatttttccctctctcacctccaccccatccatatcctctttatttcctccgttccaatgagaggcctatggctgctctccaatcccgggaagtgagtgggagcacagctgaaaagagagggtcagggggaggctggctgcttgcttaggtggaatccaagttttcccgtggccctgcctatactctggtggcctggtcctgttggggtgggggtctttggagagaagggcatagtctttgagctactaaaaagcagaattccggagcttcgagatatcttattctaggaaaatgaaacaattttaacaacagttttttttcctcttatgtcgaagatctagttttagacaatttcaaaataagcttttcccactcatagaactttaacttgccctttcagttttatcttttttttagagagaggtttaaactactgattttnnctgttgattcaaatagactaatggggtgaaagttattaggagagatactctctcctgttttctccactgaacgagactcatcttgctcttctaggtcccgtttcttcctctcttggaggacatgaaattatagaaatgttgagaagtctgcctgctttcttttgcggtaggacttggctgtgagaaaatcacctaaatcccagaaaagaggaagacagatttaaagtgcccccacccccatttgtttcaaagaggtctgcatgttgggcgaaaacagaacaactgtgtttccttttacttgttcttattattcaagagtcatttattacaggggataaatgttgggtagcaagaactttaatttgcactaccagtctcccaaatagaaaatcatgtatagtatttcatagtaataatcaggtaccttacaagctgctggtggattttaaaaaattaagatagttgaaggtggttaggtaaaatgcctgctttgtgtacaagatactctttggatctctcgtagagatggtttgttaccatcctttaatcataactaaaacattgaaaacagaacaaatgagaaaagaaaaaaaacctgccgattaacaagactgaaatcatgcatgatctgaaaggtgtggaaagaaacacaattaggtctcactctggttaggcattatttatttaattatgttgtatatcattgtttgcagggcaaacattctatgcatttgaaactgagcactaaactgggctagctttctggtagaccgttttgtggctagtgcgatttcacagtctactgcctgtttccactgaaaacatttttgtcatattcttgtattcaaagaaaaaggaaaaaagattattgtaaatattttatttaatgcacacattcacacagtggtaacagactgccagtgttcatcctgaaatgtctcacggattgatctacctgtccatgtatgtctgctgagctttctccttggttatgttttttctcttttacctttctcctcccttacttctatcagaaccaattctatgcgccaaaatacaacagggggatgtgtcccagtacacttacaaataaaacataactgaaagaagagcagttttatgatttgggtgcgtttttgtgtttatactgggccaggtcctggtagaacctttcaacaaacaaccaaacaaaaaaaaa

SEQ ID NO: 82742 - DNA, 491 bp, Homo sapiens
gcggggctagagctgtcggagaagcgggaccgcgaggccggcgcgcggcgctctgcgcggtcagagggagcgcctggcagcagcaggagcagcagcagcagcccgcggcggggccgccgccagccgccgcgaccgccgcggctgcagcctccgaagggaggccgggtgagccggcgtacgcactttcccgcggactttcggagtgtttgtggatatacatgccaagccgccacgatgatgtccatgaacagcaagcagcctcactttgccatgcatcccaccctccctgagcacaagtacccgtcgctgcactccagctccgaggccatccggcgggcctgcctgcccacgccgccggtaagcgccccacgcccgcggccccggcccgcgcgcccgcccctccccgtctccgaaacgctgcatgtcgggggctggtgtgtgcaggtcccggtgcggggaactgcgggcagggggtgtagagcagtcccgca

SEQ ID NO: 82743 - DNA, 349 bp, Homo sapiens
tcatcatgatggtgtgaaatcagtgtagagttcttgaactcaatcagcagccctttgttaagcttctgccacaggcccagtagagttactaacaggatttgagcccaactgagggcagggtcagatttggtggcagtgtgccaggtggatcacagagaggtgtaagcaactataaaattataaggacctgagatgataaaggtttggaactattgctgttggcagtaagaatggtaagtagttggtggtctgagagacttaaaatagaggactagaaaatgcttgcctgcttctaaaggcacttgttaggtagggtctgcgggatcagagtgggaatgggagaacttga

SEQ ID NO: 82744 - DNA, 292 bp, Homo sapiens
atattgttagctatttctgagccacatttaaaaggcatggttctataagctatgggcttttcttttttttttctttttttcttacctccttttgcagttttcccagatctgcaccttctgaagagcaaatgcaccttcctgggtttgtccaaatgcagatcatttatgctctcttatcacacacccacagaatgccgctctcataccgcaaaagcactggcttgccacattgtcatgtagtctcccagagacctgtctatttctagttgtgttttgtgaggcaggcaggaga

SEQ ID NO: 82745 - DNA, 357 bp, Homo sapiens
cccccaccgcccagccacgtggaactctgagtccattaaacctctttttctttataaattacccagtcttgggtatgtctttgtcagcagcatgaaagtggactaatacagctagttaacccttactcatctcttgggatctcaactcaaaagtaactttctcaggagagggatggtctaaaatttatactctcacagaccttttacatttataatgaagcatgttccatacttgggtattatatatagtatttatgaaattatttatctaaggtctgtttgcccactagaataaaagtttcatgagagcaggaagaatgtgtgatttgttccaacacggaacatgatatatactca

SEQ ID NO: 82746 - DNA, 671 bp, Homo sapiens
  misc_feature (409)..(409): n is a, c, g, or t
ggccttcgctggacttggggttccagctgctggggctgcagcaggcactggcatagttgtcaacagccccatcagccaaatgaattatttacaagttttcaagaaaggagactgcaggcagctgttggaccagacagaggatagaagcctccaggagaaataggcagttttcaaggtttcctggtataatgattcatccagaaatttatttgaaaaattacacacaaaacaacaaaaaaaaagaaaaaaaacaaaaaaaaaaaaaaaaaaaaaaaaaaaaaaaaaaaaaaaaacaaaaaaaacaaaaaaaagagaggggggggcggcgcgcccaaaaaaaatatccccgcgggggaggcgccgaaaatatcagcagagcggcaacgaccacacagttatgataaaaaanaagaagagggcgccaccaataagaggaggagggaagataaaaaaaggcgaggggagcaggcgcggcacgcagtgctaaaacaaacccgcggcagggcgggggagcagaaacagcgacgtccagggggacgcgcctctagtcggggggaaggagacgccacacaaagagagggggggggaagaaaagacaaagtaggggggaagaacaacacagcaccacgaagaaaatgatggaagaagccgccaggagagggaagaaaaac

SEQ ID NO: 82747 - DNA, 661 bp, Homo sapiens
  misc_feature (35)..(35): n is a, c, g, or t
agggaactgatttgctgtctctcagcaataaaggnttactgcatgaataaggatgacaaatgagaattctggactgtcccccccggctcctgaataatcccaggcattcaagaatacttctcttctgctattacaatgaattacatgtggagctatgaggacttcgggcttgaacagttgccgtagagctctccgtcttgctggaagggcttcttccaggccttggtcaggaggctccctgggtgctacatacaggattttttttgaggatatggagatgcgcaggacacgatcccagcaatccaggtgcttacaggctgattgtacagccatgcacacagagtgccacgatgcaaaataggatgtggtaagggtcatgcagttcagaggagaaagcaagtgtggctgatgaacatcacggagcagtgaccttcatggacagacagaatttgagctggccctttaaccaatgaggaggattcaaacagagtttgtattatcctgaaaagaaattccactaaagatgaatagcagagaactgtgttcagaatacaagttccacaaaggtagagatcttgtccctctggctacctgttgactctcctgtgcctaatacagtgcctgattcatactactcaataaatacttatggaatgaatga

SEQ ID NO: 82748 - DNA, 782 bp, Homo sapiens
  misc_feature (35)..(35): n is a, c, g, or t
agggaactgatttgctgtctctcagcaataaaggnttactgcatgaataaggatgacaaatgagaattctggactgtcccccccggctcctgaataatcccaggcattcaagaatacttctcttctgctattacaatgaattacatgtggagctatgaggacttcgggcttgaacagttgccgtagagctctccgtcttgctggaagggcttcttccaggccttggtcaggaggctccctgggtgctacatacaggattttttttgaggatatggagatgcgcaggacacgatcccagcaatccaggtgcttacaggctgattgtacagccatgcacacagagtgccacgatgcaaaataggatgtggtaagggtcatgcagttcagaggagaaagcaagtgtggctgatgaacatcacggagcagtgaccttcatggacagacagaatttgagctggccctttaaccaatgaggaggattcaaacagagaggtgtttccagttcttctcaagtacttacccttgggaaatccaagctaacagaagtcctagaggtcaacttttctctccctgaccatttgtctactatccttgtataatgaccaatcaggtttgtattatcctgaaaagaaattccactaaagatgaatagcagagaactgtgttcagaatacaagttccacaaaggtagagatcttgtccctctggctacctgttgactctcctgtgcctaatacagtgcctgattcatactactcaataaatacttatggaatgaatga

SEQ ID NO: 82749 - DNA, 472 bp, Homo sapiens
taagtagtctaagtttctggcagaacagaaaggatgggggacgctcagcaacagagggaggaaatatggagctagctaaagccacttcatgaggcgcaagcttcttccagatggcatcagagtgcatgccagcaatgggggctgtagcccaggcagagcctggcccctgtctgccaggaattagcagttcattgttcagatagcagagttgggagggtgtctgctcgtcattttacagaaaatgacagcgaggctgagatggctgaagttcccttggcttctccactaagataacttcttgagaggacaatgtgaagtgtatctcgtgcctgtgtataagctctactttctaggggtggaaaagctggtggcctgtatctggatacctgtctatccagcttccacatggtctgaatctaccctttcaatctcagaggtgtttccagttcttctcaagtacttacccttggga

SEQ ID NO: 82750 - DNA, 250 bp, Homo sapiens
tttgtattatcctgaaaagaaattccactaaagatgaatagcagagaactgtgttcaggtaagctgaattaattcctttctctggggagttatattatcaccttgatatagctagtttcacttgtttctatttcaacatttgtttttatcccgtcttcactcctccccttccctactgccaccaccctacctcgaggcgcatcctctctcacctggactactgcaggagttctgtctcttggctttaact

SEQ ID NO: 82751 - DNA, 633 bp, Homo sapiens
taaggtgtgcacttttaccgaactggtctcaagtcagtgtacaggtatgccctggctgcctccacacttccacccactcccagggagaccaaaagccttcttacatctcaaggtagggacaaaaatggggaccatgatggctgattattcaaaataaaacaaaaagtattaaggtgaagattttttaaaatgctgcattacataatttacatgaaagcaatcctgtaacctcccctttgtggactcaggagagaactgggccgttctcctgagagaagtggggtggcttttgggagggcaagggacttcctgtaacaatgcatctcacaatatgtggaatgactatttaaaaaaaaaaaaaaaaagccaggcgcagtggctcatggctgtaatctcagcactttgggacgccgaggcaggcagatcacctgaggtcaggagttcaagaccggcctgaccaacatggagaaaccccgtctctattaaaaatacaaaattagccgggcatagtggcgcatgcctgtaatcccagctacttgggaggctgaggcaggagaatcacttgaacccgggaggcggaggttgtggtgagccaagatcacgccattctactccagtctgaacaatgaaagc

SEQ ID NO: 82752 - DNA, 681 bp, Homo sapiens
ggctttgccaagccatcacacactttaaaatatagctatggttttgaatttccaaatgcattcacattaagtaattttataatgttgatattttttaaatgggaaaatgtgagttgggtcagaaagctacctttcaccctgagttctccagcttggtgacgtgtggtaccatttcattatgcaggactcagtgaacaagaagtcagttgtcatagccgtctgtttcctggtagtttacacaccagaaactgaaatctgagaatggtacttgaaggaaaacaaagagctttacagtatttttttttcttttcaggaaaacacacagaagctaattttagcgtcttgatcaaattgacccagcctttaaccctggcaaacgttaccacgacacacttccaatagacaatagtttgcataccagcattgcactggaaacagatgtgcatgcagaattggcgtcccctcccccgccgcaagactgagcccgccactgtcatgaaagttgaaatgtggtccttcctaattggggaaaaaactaggtcttctttcaaatttcaaactacaagctttcatgacttctttaaaaatttattatgtcacagttatgttttgaccagagtttcaaaatatcattcactagagaaacatctcttggctttagcatgatttttatcttggtaa

SEQ ID NO: 82753 - DNA, 915 bp, Homo sapiens
ggtaaatatattaaagaccaagatttgcagtaacatttatcatatcaaatctccaaatctagtggaggaatttaaacagaggacacagacagctcttgggagagtcttcatatttttattgatgagaatcctgaagcacagatcacagagtgagatgccagcaaatctcaaactggaattcaaggaggctgatttctgatcagtacttacaactacgattcaacaaaccagttcgctatgctgccacagtcatctacattgtacagacgattctctacacaggagtggtggtgtatgctcctgccctggcactcaatcaagtgactgggtttgatctctggggctctgtgtttgcaacaggaattgtttgcacattctactgtaccctgggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgactttgatgtagatcctctcaggcgacacactttttggactatcacagtgggaggaacttttacttggctcggaatctatggggtcaatcaatcaactattcagcgatgcatctcttgcaaaacagaaaagcatgctaagcttgccttgtattttaacttgctgggtctctggatcattctggtgtgtgctgtcttctctggcttaatcatgtactctcactttaaagactgtgacccttggacttctggcatcatctcagcaccagaccagctgatgccgtactttgtcatggagatatttgccacaatgccaggactgccaggacttttgtggcttgtgccttcagtggaactctgaggttagtatagca

SEQ ID NO: 82754 - DNA, 833 bp, Homo sapiens
ggtaaatatattaaagaccaagatttgcagtaacatttatcatatcaaatctccaaatctagtggaggaatttaaacagaggacacagacagctcttgggagagtcttcatatttttattgtacttacaactacgattcaacaaaccagttcgctatgctgccacagtcatctacattgtacagacgattctctacacaggagtggtggtgtatgctcctgccctggcactcaatcaagtgactgggtttgatctctggggctctgtgtttgcaacaggaattgtttgcacattctactgtaccctgggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgactttgatgtagatcctctcaggcgacacactttttggactatcacagtgggaggaacttttacttggctcggaatctatggggtcaatcaatcaactattcagcgatgcatctcttgcaaaacagaaaagcatgctaagcttgccttgtattttaacttgctgggtctctggatcattctggtgtgtgctgtcttctctggcttaatcatgtactctcactttaaagactgtgacccttggacttctggcatcatctcagcaccagaccagctgatgccgtactttgtcatggagatatttgccacaatgccaggactgccaggacttttgtggcttgtgccttcagtggaactctgaggttagtatagca

SEQ ID NO: 82755 - DNA, 1387 bp, Homo sapiens
cagtggttattaatttcagaacacatctgaattccttctctgtggcatatgctttaggagaggagcagacagctcttagctagggtcagatttcaaattctcatctcttggtgccaataccaccaccagattcttctttgaagtcaacttttgagatcttcactaagtacacgttggtgtctgaagattcacacgagtgcctctggtaatcattttcttcagggaatcacagtctctcctctcagcaaagcatccactgtactgaactttgcttttggaaacatcttcttcctgagacctcgttgaaagaaactctctggtgtcatactttccaatatggaggtgaagaactttgcagtttgggattatgttgtatttgcagccctctttttcatttcctctggaattggggtgttctttgccattaaggagagaaaaaaggcaacttcccgagagttcctggttgggggaaggcaaatgagctttggccctgtcggcttgtctctgacagccagcttcatgtcagctgtcacggtcctggggaccccttctgaagtctaccgctttggggcatccttcctagtcttcttcattgcttacctatttgtcatcctcttaacatcagagctctttctccctgtgttctacagatctggtatcaccagcacttatgagtacttacaactacgattcaacaaaccagttcgctatgctgccacagtcatctacattgtacagacgattctctacacaggagtggtggtgtatgctcctgccctggcactcaatcaagtgactgggtttgatctctggggctctgtgtttgcaacaggaattgtttgcacattctactgtaccctgggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgactttgatgtagatcctctcaggcgacacactttttggactatcacagtgggaggaacttttacttggctcggaatctatggggtcaatcaatcaactattcagcgatgcatctcttgcaaaacagaaaagcatgctaagcttgccttgtattttaacttgctgggtctctggatcattctggtgtgtgctgtcttctctggcttaatcatgtactctcactttaaagactgtgacccttggacttctggcatcatctcagcaccagaccagctgatgccgtactttgtcatggagatatttgccacaatgccaggactgccaggacttttgtggcttgtgccttcagtggaactctgaggttagtatagca

SEQ ID NO: 82756 - DNA, 365 bp, Homo sapiens
tgtcatgagagaaaatcactattggctcctaaattaaactataaaagcatagcaacaattcttgctttatgttgtgaggaaaactgcacttttaaatatcattggtgcaagcattatttccttcaatgtgtctgttcatatgactaaaatgtacttgatacacaagtttcttttagaaatagaaatattaaaataagtatttcctataataaattatatataatatgtattatataggcaataatacataatattataccaccagtaataggcataaattctaagcccaaaagacaaaatttgataaatgactcctttttttttttttttttgaaatggagtctggctctgttgcccaggctgga

SEQ ID NO: 82757 - DNA, 411 bp, Homo sapiens
gaatcttggcggtttttcccttgggtctctataatgtctatcaagtactttagtttcagtgtgattttcaaggaatgtgacctggggtgaaatccctggagcaaccgtgtacactctttgactgactttcagccctcgcaaatctaaacatcttgtgcttggaaaatccagactataagaaggccttttgattggcctgtttctgattataggtaagtgtgactcttacctctgaaaccctagagacacctctcatgtgctttccccacttcccaagctactgcttccatttggccctattgtgcatccttcaatccttcaacacccttttctgaaggtttttgtggaagaaagaagagttgtcttgggccacacataaatacactaatgctaacgatagctggtgagcta

SEQ ID NO: 82758 - DNA, 361 bp, Homo sapiens
actttgttctatatgcagagagagccaaaagatttttttagcaggagaatggtggggtgaaaaggataattgggtaagattcatttagccccggttatttggcatggagagaccctggagataaaggaatgaaaggtgaatataaagaccattctagaaatgtgtgcttgcctaagactttaaatggtgtcagaaggaatggggagtgaggaattaatgcaaatatatattctgaaggaagactttattggtgaaggacaggggtatctaaacttttggcttccctgggtgacactggaagaagaagagttgtcttgggccacacataaatacactaatgctaacgatagctggtgagcta

SEQ ID NO: 82759 - DNA, 417 bp, Homo sapiens
gtgggggctcagcaggacgtagaaaatccacaaattcagagatagttatatggaaaaaaatagatagaaaattgttaagaatatagaagatctgaacagcatcacccaccaatttgacctagttgacttttatagaccaatcaaagcacacagtgtttcaaatgcacacagaaagactatatatttggccataaaataaaagaaataaagacacatgtccacacaagtacatatataaaagtgtttattgtatgttactctgtaatattcaaaacctggaaacaacccaaaatgccatcaaaggtgagtggataaacatactgtgatacagccacacaatggaacactacacagcaaagaattaaataagccgttgataaacatgaaaacatgggtgaatcccaaaataactgtgtg

SEQ ID NO: 82760 - DNA, 836 bp, Homo sapiens
agaaaggattgaaaatattgaggaaaaagagattatcctgtcatgtgagatgcataagaagccatgcctccatgctgcacccctggaactcacaacaattcttgacccacaccctggatggaattttggcctctggttgccaacactcatgctgagctacgcgtagtccctctttacacccagcacactttcttctggaactttgggctatagatcccagtattgctccacctccattgaggaaactgcaaataactcaaaccagagagcttggccctctttctctgcttagccacatcagaatttcacccagtcctgtcaatttggtctcctagatgtagaaaatgtttacaggtttttcttccctatagtctccacttatctgcccccactgtgattcccaggaagcactgacaagtcctgtctgttaccacatgttaccaccctttcattcctttcttgctttgacccttgaagaagatcagaatatgacaccccaaaatgtgacactttgggcagaaggattattttgacctgcaggaaattgagaaccaacagatgtagaaacagttctctgccttccccttatctgcctaaaagcagggggatgaatttccctttgagaaaggtgctcccctaatatggttggggtttgtgtccccacccaaatctcatgtcgaattgtaatccccctcctctgtctgttcctcctgctgtggtcatggaagagatgcctgcttctcttttgccttctaccatgattgtaagtttcctgagacctccccagaagccatcatgctttctgtacagcctgtggaaccatatgccaattaaac

SEQ ID NO: 82761 - DNA, 962 bp, Homo sapiens
agaaaggattgaaaatattgaggaaaaagagattatcctgtcatgtgagatgcataagaagccatgcctccatgctgcacccctggaactcacaacaattcttgacccacaccctggatggaattttggcctctggttgccaacactcatgctgagctacgcgtagtccctctttacacccagcacactttcttctggaactttgggctatagatcccagtattgctccacctccattgaggaaactgcaaataactcaaaccagagagcttggccctctttctctgcttagccacatcagaatttcacccagtcctgtcaatttggtctcctagatgtagaaaatgtttacaggtttttcttccctatagtctccacttatctgcccccactgtgattcccaggaagcactgacaagtcctgtctgttaccacatgttaccaccctttcattcctttcttgctttgacccttgaagaagatcagaatatgacaccccaaaatgtgacactttgggcagaaggattattttgacctgcaggaaattgagaaccaacagatgtagaaacagttctctgccttccccttatctgcctaaaagcagggggatgaatttccctttgagaaaggtgctcccctaatatggttggggtttgtgtccccacccaaatctcatgtcgaattgtaatccccaatgttggaggaggggcctggtgggaaatgattggatcttggggacagatttcctccttgctgttcttgtgatagtgaatgacttctcatgatatctggtgttaaaaagtgtgtagccccccccccctcctctgtctgttcctcctgctgtggtcatggaagagatgcctgcttctcttttgccttctaccatgattgtaagtttcctgagacctccccagaagccatcatgctttctgtacagcctgtggaaccatatgccaattaaac

SEQ ID NO: 82762 - DNA, 852 bp, Homo sapiens
cgtgatgtgcctctggggcaactgaaggattgctatctgacttatgcatttaaaaccttcaaagtggaagtttgtctggaatggcttaggcaaacagactgggttggattgagaattgaatgtatacataaaatttggtttggtcagatgagaacaccaaatgtggtagctagctcacctttatttatgagatttttattgggttgatttgtcttgaaagaatcaaatctaagagaaatgtttggaatggctagatgatcctaacagaagaaatcttacaggtctttactgctaaacctaaggagatgagagtaaacagtaagtggccaactcaaagaagcatggactatgttgaaacatggactatagctgcaatttcccagtggtgcagttttcaagcgctttaccccaggagagaaaaaaataaataaatgaaaagtagccatttcaccattcagaggatagatactgttgcccagtgaaaactgcatgaattatgtaatagttttatgcttgtttcccccactcaccattccaaaactgtaagacttcaagatagaacaggaggtatgaaattttaacagcacataaaaaaatagtgaacattctatccccgcacttcattgccgttactaaggctaaggcaggactgagtttagaatgcagcaaagctttgaaatgtataagagataatatctctaatattcaaatacaccataaactcaaaacttagaatcaatcctatttttaaaatactgaatgtgactagaaacgttataaaagttttcaagatatcagtatatgatagaaagagatgtattgctttagcacaaatcattctacaaaaaaaaa

SEQ ID NO: 82763 - DNA, 940 bp, Homo sapiens
ataagtataagtatgaaggagttgaactctgttcaagtaactcagagccctttttctttttccttctaaagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttc

SEQ ID NO: 82764 - DNA, 2129 bp, Homo sapiens
agcggttaaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccacgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttc

SEQ ID NO: 82765 - DNA, 2105 bp, Homo sapiens
agcggttaaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccacgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccaggtatgagaatcaacttggtcaacagaagctggtgctacaaatgaagaaatgtgcaccagtgttgctcccaaagtggcttaggtagcccttttcatttacaaatctcaaattttaagatggatttcattgaatatatgcatttcaatggaaacaaaattctgttatagcaatgatttatttcctgggttcatagacctgaggcaatgagtcatagaatttcatgtttgattttctttaccttatcaaactacatgtttagtaattgatacttatttttattatcattatttatttttttattttttttgagatggagtctcactctgtagcccaggctggagtgcagtggcacaatctcggctcactgcaagctctgcctcccgggttcacgccattcttctgcctcagcctcccaagtagctgggactacagacacccgccaccaagcccggctaatttttgtatttttagtagagacggggtttcaccgtgttagccaggatggtctcgatttcctgacctcgtgatccgcctgcctcggcctcccaatgtgctgggattacaggcatgagacaccgtgcccagccgatacttatttttaaaaattagggcatttacaaaactattgtatgtttcagatttcagagagataaactgcatttcaagtaaaaataaacattttaatattgccatgcctcatttttcatagaaagcatggcttaaaaggcatgataagccacctgcagaataggctgtcacgtttggatctttgctaacaccctttcaagttgaaagacatatttgttgaaatttgattgtttaatatctacatatgttctctgcat

SEQ ID NO: 82766 - DNA, 2105 bp, Homo sapiens
agcggttaaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccacgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttc

SEQ ID NO: 82767 - DNA, 1477 bp, Homo sapiens
ccttacccgtcgcgcgttcaggcacccgcttccccctaccccccacaccctagaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttc

SEQ ID NO: 82768 - DNA, 2138 bp, Homo sapiens
agcggttaaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccacgacacgagttttgcaaaaacatttgttggcacaccttattacatgtctcctgaacaaatgaatcgcatgtcctacaatgagaaatcagatatctggtcattgggctgcttgctgtatgagttatgtgcattaatgtaagtatgatgaagacagattcctagtctaaggcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttc

SEQ ID NO: 82769 - DNA, 1498 bp, Homo sapiens
  misc_feature (82)..(82): n is a, c, g, or t
  misc_feature (84)..(84): n is a, c, g, or t
aatgaatcgcatgtcctacaatgaccagatatctgatttctcattgtaggacatgcgattcatttgttcaggagacatgtantnggggtgtgccaacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttc

SEQ ID NO: 82770 - DNA, 1405 bp, Homo sapiens
cttgtggacccagaacctcatgagttaaaaccaccagtgaacttatttttccaagtgtttaagacctagccataaaggagtcctttcttttgtcttggaaacacatttttgtccttttattttaactgctgtcttaggaggactattctgttatgcaatctgactataatactgagtattttttccccaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttc

SEQ ID NO: 82771 - DNA, 825 bp, Homo sapiens
gaaggattgaaccaagagggtgactgggctgagtacacagaaccttcagtgactgattgattgaccagaacactgctgctcaagcatatgagaggatatagatctggctggacaagtttgccagcccgactctagagaaatctcagctgagaaagtctgcaaagaaatttggctgtgtctaccttggtctttacctcattatcaatgagcaggggctaatttcttcacctgcaaccctattgcacggtcattatcaggactgagtcaataactgcaaaacatttcaaatagagccacatgaagaggaactcaaacatcagatgaatggaatcacatattttatggaagtcagccaagcctcaagagacccttgaaccaagcagctatggcagcagggatggcaggtctacacaggatcaacaacatagattcccttccaccaagtctaagccagcaactgccactgctgagtgctcaatccctcaatgaagagaacaacacacagcccttgatatgacaccattcatcactggacatctccaccttaaggggacagaagctcatctttatcagaatctatacctacttcatatcaccttccctgccttcattgcctctgccagctccagcaactgggagtttataggatgcctaatctcaacatggcactctgcattatgtcttctcaaacctctcatcttaaggaggtacaagagtgggcccatgaccataggatttcctggtcctactatctaccccattaccagaaacagccagcctgacagaacagtggaggagcttactgaagactcagttgaagagtct

SEQ ID NO: 82772 - DNA, 728 bp, Homo sapiens
gtctcccgggagctgcttctccccacactccgcccctgcgcctccccgagcttcagcctctcctgtaaagagcagagatggagaggaagcgacagtcacaacttccggttagcgtggcggaggctctcggagtctttgggacctcagcaccgggataccgggagactccctcgtgtccccatgtgggccacctaccagacagaagagacaggcttggaattcaaaactctgacagactctccatcccatgcaaattccatctctttgtgactgtgctcttctctttggttcatgccacatcattgcaaagttaaatgaggttctaggtagcacagggcgtggagtttgctgaaggatcactcacacaagcggctgcccgctgttcctggctcagtgctcaccactgcacgtcacaaggagcggcaccatggctcccgtaacaggaaaaccctgcatttgctactcccggctgcacgagagtggagggaggcttggacctttccaccacccccttccctttgttgccagctactcttacccactagtctactcaagtcacctcagcagacacccaagacccaaactgagaggcgctgctggtggtgcggagagcgacacagtccaaaataagacgcggagcccgagctgtcaggctgtgagtgacagccgggctcctagggctgactgacaagttctctcccttcttgtggcaagccatgtgcgagccc

SEQ ID NO: 82773 - DNA, 185 bp, Homo sapiens
cgcctggtctggcactcttcacatgccctctccatgcccatctccagcaaaggatagcgggcttacccttgctatcaaaggtgcttggcttagaccaatcacccaaaactgatgtttcagagatgcctgctggaggagtgtaggcagatattactgatgtcagaaaaacagtttgagcgccactt

SEQ ID NO: 82774 - DNA, 454 bp, Homo sapiens
tttagaggtgcaccagtttctttcaaatcttgaaacagcgcaactaagagatctaggagattgctacattgttgaggttgggctccttgaaagccaatttcccatgaaaatcaggtgcatatgcacagtgatataagctattcaacaagtatctgaatgtatttgtcatcaatgatctttgtccctgatatggcctggctctgtgtccccacccaaatctcatcttgaattgtaatccaaactgtaatccccacatgttgcgggagggaccttgtgggaggtgattagatcatggggctggttcccccatgctgttctcatgatagtgaatgagttctcatgagatctgatggttttataaggggctttccctgcttcactctgcacttgtctctcctgccaccatgtgaagaaagacgtgtttgcttccccttccgccaggattgtaagtttc

SEQ ID NO: 82775 - DNA, 409 bp, Homo sapiens
gcagcagagtacatattcttttcaagtgcaaatgtaacattcaccaagatagaccatattccaggccatacaaatctcattaaacttaactgaattgagataaaataatacaatgtatgttctctggccaaaagaaaatagaaatagaaattaattacagaaagatatattaaaaatctccaaatattaaaaaactaaacactatgcttttaataaaatacgagtcaaagaagataccatagttaaaattataaaatattttgaatgaaaccaaatgaaaacaaaacctattaggatttgttagtgtgacccaaacagcacttggttggaaagttataacattaaatgcatatattcaaaaagaagaaagttctcacattaatgatccaagcttcaatcttaacatact

SEQ ID NO: 82776 - DNA, 802 bp, Homo sapiens
ttcagaaatggacatgtgacccaatcaaagccagagatgcagaaactcttgctgggactttcggagaaaagactcactctcaactcctcaaagttgggtggatgtgaggccagagttgctgttgctatcttgctaccatcagatgacagcctgagaatggagtttacccaaagggaatggagacaacagatgaagtgcaagaagccaggacaagatatccatgtttgcaccctggtcaaatgttacctgaagccactttagctcctggagtttgcagttacatgagggaacaaacttcatttttgcttatgtcagaatttttgttacttataatggaatcaatccaaagtggtacagtgctttttatcccataagctacatagtgatctctttttcctttctttgcagtatctaaaccattcattctttaaatcccacttaaatgctacctcatccatgaaacaatctctgctttcttgtgccataagaactctctcccttctttgaaatcccagagcattttacatgttggtctcttatggaacatcccttactatagtgtactaattttctttagatacatggcttgtcccctgtaagctcttggcagcttcagggcaggacttttgttgtgattatctttttatcacaggacacacaaggtgctttgaataaaatgaggtctcaattcatatttatggaatgaacagatgaatcaatgaaatggactttgtctctgagcaggcaatacactctgggaagaagccagttttgctccataggaggaagagaacaaactgct

SEQ ID NO: 82777 - DNA, 581 bp, Homo sapiens
gacaactagtggggatgaggagcagcgtggacaggcccaaggagctgggggacagatggtggtgacagggtctcactctggggcccaggctggagtgcggtatcatgatcacaactcactgcagcctcaacctcctgggctcaaagatggctcacagatggctgctttgatgtttacaaggaggtgttgcgtcacaggttgggaggtcatgaattatgtcatgctccatgtgggggacatgaattatgtcatgctccgtgtgggggacatgaattatggacggcagtaagggattccagaggcagctcaccagtggcccacggagcccttctcagcttggcctccccacctcccaccgtggccacccctcctgcccctgcaggccttcataactgcgcatccaggcagcttccttgctgaagcaccctctccgcagaactcctgctcattcctcaagacccagctcgactgtctgtcctctgtgacacgtcctgattccaggcagcatgaggggcgtccgccaccccacgttggttcctacagcacactgtgtcagtgtggcatcatccatccatgtcccc

SEQ ID NO: 82778 - DNA, 202 bp, Homo sapiens
aattaggagagtttcaaactcacagtgtcttagtttgatttctgttccttataacaatacctgaaactgggtaattaataaagaaaaggaatttatttctttgttatggaggctgggaagtctaaggtcaaagggtggcatctgtgagagccttcttgctggtggggactctgcagtgtcctggggcagcgcaggcactaca

SEQ ID NO: 82779 - DNA, 688 bp, Homo sapiens
  misc_feature (679)..(679): n is a, c, g, or t
cttgattcctggactcatgaatcctggacatggaagaaacagcaccataaattggatgctgattcagagcatatacagccttctgcagaactttgccccagccctgaaatatgttgccaactagctagtgctgtaactgaagctccaaaaggccattccactgtactatcaaaccagctgcttcaggatggtgaagaacatggtcaagtaaaaattgagtgggcttcctatctatttcacttcgagaaacaccaggattaactagccaacaccataggtctgcatgagtcagattattctgattgctgcattgaatctgctgtccggacgggacacagaaggaattgaataaagtcatggaaaatgaaactcaggttggtcttctcactggcttcttaaaggaatgagcacattgtgatcctgctctgtatcgtggagaaagacccaaggatgatgagaagttctgcttttggaatagcagcatcaacagctacatggacctgcttctgggaaaaacaagtgtaactgccatcttttcatcacaatgggacagcctgtctgagaatgaggccagtgcaaagaagaaagtggagcccacgtacagagagatgatacattgatgatatcatgtgtcctagattcatgcttcatatgaaggagtcccattataccgatactnaaacacaaa

SEQ ID NO: 82780 - DNA, 449 bp, Homo sapiens
aaactattagtaatcaaattcctgttggacataaatcgtaactagtgaggcagagtaaccaggtggaatatcacagaccttggaatgaatgagaactgttttccaacccaggcttgtgagctgtgagattgtgaacatgtttcctaacctctgtgagcctctgtttcctcatttatgaaacagaaataataatacatgcctcacagggttgttaagagggtcaagtgacatagtgcatgtcaggctgttagcagtaacaggtgacaaggcttctaactattgaattctgtttccctctcccctatttctaacttatctgtggctgtaaatagacactttgagggatttaaatgtacagtgtatatgttccatgaaacccagaacttatctgtatccccaaggaatattacttagcacatagttgaggttcaataaatatttgtttaatg

SEQ ID NO: 82781 - DNA, 1868 bp, Homo sapiens
atccaaacgggaatgcagaaagaatggaacaggatgcgaagagatttggtcaggctgcctgggccacagcaattcccaggttggaaaaacttcagctaatgctagctcgagagactctgcaactcatgagagcgaaagagttgtgtttaaatcacaaaagagctgaaattcagggaaagatggaagatcttccagaacaagaaaaaaatacaaatgttgtagatgaattagaaatacaattttatgaaattcaattagaactatatgaagttaaatttgagatattaaaaaacgaagaaatactgcttactacacagttggactctcttaaaagacttataaaagaaaaacaagatgaagttgtctattacgatccatgtgaaaatccagaggaacttaaagtcattgactgtgtggtggggctgcaggatgataagaatttggaagtgaaagaactcagaaggcagtgccagcagctggagtctaaacggggcaggatctgtgccaaaagagcctctctccggagtagaaaggatcagtgcaaagaaaatcatcggttcagattgcaacaggctgaagaaagcataagatactctcgtcagcatcacagtattcagatgaaaagagacaagataaaagaagaggagcaaaagaaaaaagaatggatcaaccaagaacgtcaaaaaacactccaacgattgagatcatttaaagataaacgcctagctcaatctgtccgaaacacctctggctcagaacctgtggctccaaacctgccaagtgatctttcccagcagatgtgcttgccagcttcccacgcggtgtcagtaattcacccgtcctctaggaaaactagaggtgttcccctatcggaagctggtaatgtgaaaagccccaagtgtcaaaactgtcatggaaatatccctgtccaggtttttgttccagttggtgatcaaacacattccaaatccagtgaggaattgtcactgccaccacctcctcctcctccaccaccaccaccgccgccaccgccgcccccaccccctcctctccgtgctctgtcctcatcctctcaagctgcaactcatcagaacttaggcttccgggctccagtgaaagatgaccagccacgtcctctagtgtgcgaatcacctgctgagcgaccacgtgactccttggaaagtttttcatgtccaggatctatggatgaagtgttggcctccttaaggcatggcagagctcctctccggaaggtggaagtgccggcggtgcgccctccccacgcctcaatcaatgagcacattctggctgccataaggcaaggggtcaaactgaagaaagttcaccctgatcttggcccaaaccccagcagcaaaccaaccagcaacagacgcaccagtgaccttgagaggagcatcaaggctgcgctccagagaatcaagagggtgtctgctgactctgaggaggacagtgatgagcaggaccctggccagtgggatggttaggctcaagtttgacaaaggcacctgccacagtaggcttgaataaagtgggtgagtcttagacctatcgaaaagcatactaacagggtgctgatagatgggccacataacaccccggaagatcagcagggccttgtgtaggctgctgcagcattttttttttttttcttttttgagatggagtctcactctgtcgcccaggctggggtgcagtggcgccatctcggctcaccgcaagctccgcttcccaggctggggtgcagtggtgcgatcttggctcactgcaagctccgcctcctgggttcacgccattctcctgcctcagcctcccgagtagctgggactacaggcgccaccaccttgccc

SEQ ID NO: 82782 - DNA, 1700 bp, Homo sapiens
tcagtggtgggattacaagtgatctttatttttcttacatttaaaaaaattcaatgcattttttaaaataataaaatatgttttaaacaatcattaatacatttttagaaaaacaagatgaagttgtctattacgatccatgtgaaaatccagaggaacttaaagtcattgactgtgtggtggggctgcaggatgataagaatttggaagtgaaagaactcagaaggcagtgccagcagctggagtctaaacggggcaggatctgtgccaaaagagcctctctccggagtagaaaggtaggtacgctcagagcggctttcttttcttttctctttcagagatttattcttgtatgaaggataaaggtattgaaataaggtttttaccaacacagtgattacattttgtgtgcttatgtacttatccatggctatagttaaaatgcttttaaatatttttcttaaaaatattttttttcttttgggatttaagcatttagcaaatctcaaggttttaatttattcattcaacaactatttgttgaatgcccattgcatacacaggcacacaggcactttatttttatttttttgagacagagtcttgctctgtcacccaggctagagtgcagaggcatgatgttggctcactgcaacttctgcctcctaggttcaagcgatcctcatgccttagcctgccaagtagctgggtttacaggcacgcgccagcacgcccagctaatttttgtatattttgtagaggtggggtttcaccatgttggctaggctggtcttgaactcctgacctcaagtgatccgcccaccttggcctcccaaagtgctgggattacaggtgtgagccaccacccctggaccacagtactttaaaaaccacaataggtagaaactctatttctaatagccaactataacaattctaaatatattttactgtaaattattgagtacacaaaagaattacagataacaatattcagctcacctcagacattatatttggtgattttttttcttaattttaaaaaatccatgaatacataaaaagataacactaagaaatttaattttctctgacagaaaaggaagctcctatatatcatttttatacagacttttatatgtatttactcatatttactatacttttctcctttttttttttttgaaacagagtctcgctctgtctcctagtctggagtgcaatggcgcaatctcagctcactgcaacctccacctcccaggttcaagcgagtcttctgcctcagcctcccgtgtagctgggattacaggtgcctgccaccacacccggctaatatatatatatatatatttttgagatgggagtctcactctgtcgccaggctggagtgcagtggcacgatctcggctcactgcaaccttcatctccaggattcaagcctgcctcagccccctgagtagctgggattacaggcatgtgccaccacccctggctaatttttgtatttttagtagagacggggtttcaccatgttggccaagctggtcttgaactcctgacctcaggtgatccacccgccttggcctcccaaagtgctgggattacgggcatgagtcacagcgcctggccacacccggctaatttttgtatttttagtagagacggggtttcaccatgttggtcagactggtcttgaattc

SEQ ID NO: 82783 - DNA, 671 bp, Homo sapiens
atccaaacgggaatgcagaaagaatggaacaggatgcgaagagatttggtcaggctgcctgggccacagcaattcccaggttggaaaaacttcagctaatgctagctcgagagactctgcaactcatgagagcgaaagagttgtgtttaaatcacaaaagagctgaaattcagggaaagatggaagatcttccagaacaagaaaaaaatacaaatgttgtagatgaattagaaatacaattttatgaaattcaattagaactatatgaagttaaatttgagatattaaaaaacgaagaaatactgcttactacacagttggactctcttaaaagacttataaaagaaaaacaagatgaagttgtctattacgatccatgtgaaaatccagaggaacttaaagtcattgactgtgtggtggggctgcaggatgataagaatttggaagtgaaagaactcagaaggcagtgccagcagctggagtctaaacggggcaggatctgtgccaaaagagcctctctccggagtagaaaggtgatttgtattattccaccaggatcagtgcaaagaaaatcatcggttcagattgcaacaggctgaagaaagcataagatactctcgtcagcatcacagtattcagatgaaaagagacaagataaaagaagaggagca

SEQ ID NO: 82784 - DNA, 396 bp, Homo sapiens
aaccttttttgggaggttactctcgctctgctgccatgagtcctgggaccattcccaagcaaaacctgggactcttccaggcacagcctggagttctgctcgggcctctccctttatggcttcttcaaagagcagcctcactcctggctgctggggtataccaaccgacataccaccactgctagaagaaaatggatcatcttgggttctgtccctgggatagtattcctgccaagagttctgcaactgtggctgtggctctatttttgtaacaattcaattccacagatatttactgagcccctatgttaagcagaagactgtgctaggtgctttgatgattatacaatataaaacatggtccctgccctctgagagtgacagtcccctcagcca

SEQ ID NO: 82785 - DNA, 1398 bp, Homo sapiens
caacatttgaatttaatttgacttctattttcagtaaattagagtgaaattttagggatgtctttatctcctatagtgtgtgttttgccaagatttattaagggtaatttggattttagaaaatgtacagtttctaaaggcttgtgaacgttttatattgatagaaaatgtaagtaagactagtaacacattattttctccaaaggatcctgtgactgacacaaaaaatatgatataatattgaatctgccaaaagatgcactgttaatctagggttatgttatgttgttattttattaggtatgtgatactatggtgtgaattttagaatataggtaattatttaagtaattactgtaattctaaacatcttctgagatgttttctctaaagcagaaactcagcttttactcatgtttagataatgtgatatagctgttctagatatttgagattagggttgaggcaaattgttgacatataattaaaatgtattttataactaaaatttagaagaatggaaaaagtttacattgtatttataagactttgctaacatgctttatgacattacggagaagtactaggaagaaggagatctttaaaaggagtgatattctgtttgctttgctggagtaccttatcaggaaatttgaaatcttagccctttaattgtgatatctgttaattctaaaacttacactgaatttaactttgaaggtcaacatatggatttttttaaaaacaatatttactctatcaaaagattagttgtatttttgacttgaggaaatagcttaatctgaacagcacgaaacttgacaaaaaagtttgctaatacataaatattggctattttaatctgttgaaaacggaaggctagtaccaagggagacggtagtaaaattatagaaggagctagtgaaaagtaaacattatgcaacatgaaaagaatactaggggaaaaactgacagagtagaataacaggaagattagtcacttctggaaggaaaaaagtaggtaggggcagggggatgaagtactttaaacaggaatgtggaactggaagtgctagggctaaaagacagatgtgagcttatttgggagctaaactgggctttgaaaaaggaataatactggtagcatttaatatcaaaatttaaattttatgttaacaataagaaaaaaatggagaaaaatttttgttagggattataaaatgcctgttaaaataaaaagacttatatttactcctttgtggagctgaattggtttcggtcagacagcaatgtcaaatgcaaatcaagaaaatacatttctgaggccaaggcaggagatttcttgaccccagaaatttgcaacaaccccaaggaacatagtgagactctgtctctacc

SEQ ID NO: 82786 - DNA, 1037 bp, Homo sapiens
tgattttatatgacaaaagaatctgcactttgatttgtatttctgctgcttccacaaatacactttcttattttttccgtatggagtaaaataacaaggtgagttaatatttattgaaacttaatgtatgtcaatcagtgttttcagtgcttttcatttttttcatagtattttgtccctataaaatctcatcgagatagttactggtgttacttccatttcacagatggacacactgaaatacagagaagttaggtaatacatgcaaggtcagtcagccagtaaaatgtggacttggagcctcgtaatctgatttcacagcctgtactcttaattgttttgttatgtttgctggaaaacattgcttcttaatttccatatgcatattctaaggattcgacaaagaaaatataactaacagcagtacttaagaataaaaatgaatatccaagacaaatttatagtacagggcctaaaacagtaagtactcagaagtaatcactgtattttaagtcaacaaatgagtcaaggagtgaaccctaaaattatagaaggagctagtgaaaagtaaacattatgcaacatgaaaagaatactaggggaaaaactgacagagtagaataacaggaagattagtcacttctggaaggaaaaaagtaggtaggggcagggggatgaagtactttaaacaggaatgtggaactggaagtgctagggctaaaagacagatgtgagcttatttgggagctaaactgggctttgaaaaaggaataatactggtagcatttaatatcaaaatttaaattttatgttaacaataagaaaaaaatggagaaaaatttttgttagggattataaaatgcctgttaaaataaaaagacttatatttactcctttgtggagctgaattggtttcggtcagacagcaatgtcaaatgcaaatcaagaaaatacatttctgaggccaaggcaggagatttcttgaccccagaaatttgcaacaaccccaaggaacatagtgagactctgtctctacc

SEQ ID NO: 82787 - DNA, 448 bp, Homo sapiens
taacttctacattttgaaaattttatgtcaattatttaatagaatatctctaaatttaggtttgtctcatttttcaatgtaattggattcaggttacgcatttttgatagattagagtggtgctgtgttattcttattgcacaggtctgttgggttgagtggggtgagttaaatcattcctttttggcctctcataatactgaatcaagtgaaagttggcctgagtcatcagaagacttgtctcggctgaatgtacaaggtgctcactgacatatacagatccaaagttgagtcggactggtctgactgttggctgaaagctcacctggggctgccagaggtcttcaaccatagcgtctccacgtaacttaagcttcttatatcatgtgcctaaattctgagacagaggaatagagaagagagaaaggaagagcaagagagagaaggg

SEQ ID NO: 82788 - DNA, 407 bp, Homo sapiens
atgaaaataatattttaaattaatttatatactgctgaattccacaatggatttgaatcaggtattccaaaaacataaggctgcagaatttttcctctgtttgggctcttttgttctctttattaatgcatgattttgctttcactcgttaaggcacacacatttgatctcttgagcccgaggtatagtatgactaacaagctggcccatctctagaggtactgacttttccttttcaagtgctagagcggctacaaactccgatattgtcatggattggtgatgtgacaaacttattggtaagtttcatagccacagaggattactggaacgtctctaggtttagaagctttgtgccaattttcctagctaatagagtaagaagtcaactcccaaggatgtctggc

SEQ ID NO: 82789 - DNA, 769 bp, Homo sapiens
gtataattttgtttttagttggtgtgggtaagacagttttttatctttgtttccctggtcttctattatcttactttttgataggaatagtatagtagaatgaatagttctttttggcttgtagaaatgacttaagctatgatttttccttcctcccttcaacaaaggtgattgaccctgcagggaacagagcactggatttaaaactatatgataaaaccccagacaaatctgattgttttgccacttccaacttttaggaggatgggggaaaagttatgccaatatgttatatcaggtttaattaaaaagtaatttccaggccaggcacagtggctgggattacaggcgtgagccactgtgcccagccaaccacagaatattgtgtctattcatgagtacctcaagttttccctcttcatttacaatagtagcttaggaagaacccaagtattttgctagaagatggtattggagcttgggaggaggaagagtaacagtggtgaggctgcagttgctaggaggccggcttgggtgagagggaagggagaacatggtctttgatactgggagagagtatcctgccttcttttcctgtgggtttaggtcagatgagaaatgaatccttgacaatgtgcagcaagtgagaagaggtgattatctcttcacctcttcccctctctgagaagaagtagaagggctgtttggagagaccaagggtctctgctaggctctggctaagggaatgaagtgattctttcaggggaaa

SEQ ID NO: 82790 - DNA, 424 bp, Homo sapiens
  misc_feature (371)..(371): n is a, c, g, or t
  misc_feature (373)..(373): n is a, c, g, or t
  misc_feature (382)..(382): n is a, c, g, or t
  misc_feature (395)..(395): n is a, c, g, or t
gtataattttgtttttagttggtgtgggtaagacagttttttatctttgtttccctggtcttctattatcttactttttgataggaatagtatagtagaatgaatagttctttttggcttgtagaaatgacttaagctatgatttttccttcctcccttcaacaaaggtgattgaccctgcagggaacagagcactggatttaaaactatatgataaaaccccagacaaatctgattgttttgccacttccaacttttaggaggatgggggaaaagttatgccaatatgttatatcaggtttaattaaaaagtaatttccaggccaggcacagcctcttttttttgttgttgttaagactggggtgttgcncngttgttttngggcttggagttngttgatgtggatccatgggctccattggc

SEQ ID NO: 82791 - DNA, 374 bp, Homo sapiens
  misc_feature (7)..(7): n is a, c, g, or t
cgccggnacccaacacctaataagtttacttgccaaaaaaaaaaaatctattaaaaatctctcaacccagggccagcaatctgttttttttttttaatggaaacagggttcccctctgtcacccagactggaatgcaacagcgtgatcacagctaactgcagcctaaacctccccaggctaaagcgattctcccacctaagcctcctgagtaactggaattacaaggacacaccacgacacccggttttttttctgggtctttagaagacacggggttttgccatgttgcccaggctggtctcaaaactcctgagctcaagcaatccgtccaccttggcctcccaaagtgctgggattacaggcgtgagccacc

SEQ ID NO: 82792 - DNA, 819 bp, Homo sapiens
ctggctgctgtcctcatgtccttggctctgcctggtgaagccaagggcacttcagaacctccctgtgcctccatgtgccaggttggggctggcacgaggccacagcaggggctggcaggtggtgacctctgctcctcgacctgggatgctccaggttgagacgtagggtagctgcagtcccacgcaatgacaagctctgggtaaccctgtgtgagtggacggccaagtgcgagcccagcctcagtcactggggggtggacgtgccaatggtggatgcccatgcctctgtgtcacttgggggggtggactggccaacggggagcccatgcctcgtgtcacgtgcgcgggtggactgtgccaattgtgtgatgcccatgcctcgtgtcacctgggtggtgtgtgagactgtgccaatggtggatgccctatgcctcgagtccacttggtgtgtggtgttgtgactgtgcccaatgtgcggatgctccaagcactacagagatcatatgccgggggctgagacagtgctcataggcggatgcgcctagcactacggtacacttgcgtggtgtggaccggcccaatggcgatgtcccatggagcgtcagctggaaggagtgagaaactgcagggacagaatcgtgcagctagtcacatatgtctgcaaggaggatgcgacatgagtccgcttgacaggagcccatgctgtaagtgttgccgtagggatgtgctgcacggtgcgagccatgcgtcagcggaggccggcaccaaggtacaccaaagagcagggtgatagcctgaagtgagtgtactagggacaag

SEQ ID NO: 82793 - DNA, 528 bp, Homo sapiens
ccagaattgcaaattttctctgctgatttgtgtcctaccgattctggcttgctttccccctacactactagggctactctcactttcacacctagcaaaacttcacctttcaaagaatttaggcagaatagtcctaatttagttaataagctttcattttaaatcttagggaagcagtgttagtttcagttattctataggaacagaaattggagctgccacagccttttgaaccagagcccggcagaccctcagcttcagccctgctcagtgttttgtgtctatgaaagtctttttaattttctcattacacattttatatatcatgctatgtatttagaacagaggggttgtgtaagattatgactctatgttctttatcttgtctttgtattaatttgaagttgtgttttttctttatttgtagccaactaattaaaataccaacatatttatttttattcatttttatgtgacaaacttttaaactgaagactgcatcaataaaattgcatgccattaaatatg

SEQ ID NO: 82794 - DNA, 401 bp, Homo sapiens
ttaagcacacgctttatttagggcacataaattggtacagaaaaagaaagaatggagccttctcctagaaaggtctataccctacaacaggagtccccagacccgggctgcagactggtactggtctgtggtcctgttaggaacctggccacacagcaagaggtgagtggagggtgagtgagcattaccacctgagctctgccttgtgtcagatcagtggcagcattagattctcacgagagcacgaaccctattgcgaactgtgtatatgagggatttaggttgcgggctccttatgagaatctaatgcctgatgatctgaggtagaacagtttgagcctgaaaccatctccccaccccccactcccctcaccacctaataaaggaatagttaacactca

SEQ ID NO: 82795 - DNA, 704 bp, Homo sapiens
caaaacctcagccaaagaggtgagtcctcactgcatggtttgtgaaggaagtgactgtaaacatccagtatcagaggcccaagtggatacactacggtgcctccctacgctgggccatgagctgttaaagtgcggctgtgactaaatatggattgacgtggagagagattcaaggtgacgctgaaaaacgtgcatgctgcaaaacagtatgcaggatttaactgtatttttataaaatatgcaatcacgtctagataaatgactggaataacgtatatgcaaaggtatcaatagccatcattcatccctgtataatgggaatatatgggcctttatgctaatctgtgttttctataataagaaaaattaagcataaacaaaacaataatttagttgtaattttttcaaaaggcagcactggagtgtcatgggccaattaccacccaggaaaacctgaagtctggaagaaagacttgttgcacccataccaggagaccaggagggtgaggataaagcttgtctgtccccagcccagcacagactgcacctactgaccactcgccatcccaagagagaagacaatttgtcttcccaaatgccagtgcaggaagggacctctgattattcaaccctcatgtcaccaggtagaaaaagaaggtctccaaagggggctttgcctaggtcacacaagtagttggtgacct

SEQ ID NO: 82796 - DNA, 554 bp, Homo sapiens
tctggtcgcaggaggcaatgtctaggtgtgcagcagattgcaggggagggcagatggtagtagggagatttgattcccttctgacttaattctcactgcttttttgtatcaccttcccactgtggaccccatggccctaacattgccctggaacggtacagcttcttgttcagtgtttatctgaacctacttctggatggcatttcctcctgtgtcttcatgttctctgctccccttcggccattgtatctatgaagaaggcattgtcaccatgtgccatggctcacccctgtaatcccagcactttgggaggctgaggcaggaggatcacttgaacccaggaatttgagaatttgagaccagcctggtcaacatagcaagaccctatctctatgaaaacaatttaaaaatcagctaagcgtgacagcctgcatctgtaatctcagctacttggaggctgaagtgggaggatccttagactcagggagctgaggctgcagtaagacgactgcatcactgcactgcagcctaggtgacagagggagatcttatct

SEQ ID NO: 82797 - DNA, 444 bp, Homo sapiens
tgtggcaggaggccatgcaattgggctctagtcttgcttcattcaactgaaccaggaaagaaacagatccacgcactctgatacccatttccgttgttctaggaggtaaatgatttcgttcctacaagccagacagtagccagctttcactaaagaagaatcgactccttagtatcttgtcatgccattggttctgatgcataagtgaaccctgtttttaacggaagctccttttttttcacctcaggacctacccaagactgtctagatactggcaggacaaggtacaggagttttcagcagaaagtggagttgccaggagagatgctgggcacttgcactgtgactttggagtgccgggaaaagttccagggtccccagtgcttacttagataaatggcatttaaaatagtgcagccttttatcattgcttagtctaattta

SEQ ID NO: 82798 - DNA, 468 bp, Homo sapiens
ccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacacacacagagagagagagaacgagctcagtgaattgtccaggtgacgcactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtagg

SEQ ID NO: 82799 - DNA, 1047 bp, Homo sapiens
gcgaaatcactagtgattccccaccaagccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagagcattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattacaaaaaaaaaactaaact

SEQ ID NO: 82800 - DNA, 1833 bp, Homo sapiens
cctgtggctgccagagcagctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagagcattccgaaagatgggactggttgactcttcacatgatggagaatctcctattggtgaatgacaagcagcatgctggcgggtatcaagcttctgcatgaccagcggaaagacttcttcaggccgtcaccagatgtgggcccttgactttggacttcccagcctccagaactgtaagaaataaatatctgttctttatg

SEQ ID NO: 82801 - DNA, 2012 bp, Homo sapiens
cctgtggctgccagagcagctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagagcattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattacaaaaaaaaaactaaact

SEQ ID NO: 82802 - DNA, 2034 bp, Homo sapiens
cctgtggctgccagagcagctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagccagcgctgctggcagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagagcattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattacaaaaaaaaaactaaact

SEQ ID NO: 82803 - DNA, 1075 bp, Homo sapiens
gccccgaacattacgatataacaccatcaacacaccaaagcacacaacccggctagccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagagcattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattacaaaaaaaaaactaaact

SEQ ID NO: 82804 - DNA, 1813 bp, Homo sapiens
cctgtggctgccagagcagctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattacaaaaaaaaaactaaact

SEQ ID NO: 82805 - DNA, 277 bp, Homo sapiens
aagaacatttaagtagttcatacaaagaaatataaattgttcttaaatatatcaaaatatactcacctcattcatagtaaaagaaataaaaaactgtgctctgatgacatttttcatctatgagatttacaaagatctaaaaattgagaatatacattttctattgcctttggatggcaatttggcagtaactatcaaaagtataaatatctataccctttgaggtgtcaatctcattttaaagaatttattcttcagctatgtacatacatgtagg

SEQ ID NO: 82806 - DNA, 220 bp, Homo sapiens
  misc_feature (194)..(194): n is a, c, g, or t
gaattccacgggtatacagtcataaattgcaatttaaataaaagcgtttcagtgcctacaagacccaggctccaaattgagggctttggggtgatggggatcttcttctgcttgtttcttttttacttaaaccacattggaaggtaagaattttcaggaggaaaaacattgtcttacttccgtgttgcccaccngctctgtattttagctgaacttctaa

SEQ ID NO: 82807 - DNA, 403 bp, Homo sapiens
caaaatcactcccaaaagtagttattgtcctctttattttgtagatggagaaacaaagaggacttatatgactcatagctgctcagtggcagaggtggggtgaaatccagggctacttccattccaaagctgatacccgcctcattctgttttctttcccagcctgggcaacaagagcaaaaactccatcacacacacacatacaaaagaaattactgtagaaacaaaacttggcataaagcagcagtaggctctgtccttgtgaaggaagtgggggctttcccccttctagttttactacttcatgacctttgaccatatttttagttttttctttagaaaaaaatcgagattgcgccattgcactccaccctgggtaacaagagtgaaacaccttctcaaa

SEQ ID NO: 82808 - DNA, 339 bp, Homo sapiens
tgctaggattacaggcgtgagtcactgcgcccggcctcgaaagccctttctctatggtggatcaaaggcacactcccctcagtctgtctcttcctgtctggaaatgtggcctggggttgccaagccccctcaggtatgccaagcaccctgtcccagaatctgtagccggtcagataagcttagcaaggcctgactcattcattcagcaaacctttcctaagttccctctaaggaccaagctttgtcaagaccccgtggatacaactgtaaacaaaacaaagtacctccccctcagagccagtgatcaggcacacagatcataccatactttagtaactc

SEQ ID NO: 82809 - DNA, 444 bp, Homo sapiens
acaggaataactaatatttattgaatatttaccatgtgcctgccagacactgggctaagcattttatacagattaacttatttattttccacatcaatcctataagataagaacttttattataaccatattacagataaggacattgaagttcagagtagctaaatgatttacccaagaccacacaggtagaaactgatggagctgggttcaaacccaggattgttggaccccagaacacactcttttaaccactggacaataccactttcctgaacagctgaagtcccttttgagcttccctttcaaaaaccaaaacctaatatctttatgtcatttctttctctgagttgtacattctttaaataataccaatgtaactgacatcaggtctcaatgtacctgatgttagattatacaaaagaatataaatgacattcatag

SEQ ID NO: 82810 - DNA, 394 bp, Homo sapiens
aggtggtagatattaaagctggaggggaggctcagatgattctctgtcctgtactattataatatttctggtctttatgcaattttcatttacaggcaatccaggaagcaagtgcaggaaaggctcagttgggtggttgactatactcaagtcttgccaggacttctaaagttgacaaccacaaccataaatagaaacaccacttcattctcaacattctccctccccacagcaccctcaccccttaagtcacctcccccttccttccttacactgtcgctgaagacagagatgactcttctgcttcaatccaggatattaatgtctacaaaagacttaaagaattgaaatagagatcaggtcactagctcactggctcattctctctctcatt

SEQ ID NO: 82811 - DNA, 652 bp, Homo sapiens
ctttgtaagaattgagacctatgtgaaaaacctaagtctttactaaagctagaagaccttatcaatgaagagatgtaccgcaatcctgaatgtgaagacaaaatagaaataaatttatacattaaatactatgctagtaaaaatctttcatttttcttggtgtgcatatggggtggggagggggatttgacttccaaattcatctgaaatccagtccatgtggtactggcacaggaatagtcaaagaggtcagtgacactgcagcagtggctttcaaccttggttttagattgaaatcattttggaacttgaaaaaacactacccattctactttaattcatgtgagatgaggttcaggttgtgctatactttaagtgttttcaaaggcaattctgatgggtagccaaggttgtgaattactgaactataaagaccaagaaatggcttgtgcacatatagcatgataaataagaaagactttcaaatcagcaggttattgggacaactactttaaggacaaaaataaagctagatttcttactaacactaatagtaagacagaaataaatttcagacagacaagaaccgtgatatacaataaatacataaaatttaaaaaatgcaataaataatataattaattaattgatt

SEQ ID NO: 82812 - DNA, 590 bp, Homo sapiens
gttcctggcttgtaacagaaactcattacacatttattgaatgaatgaataaataattctctcctctcttggtttctttggctctgcctttgtctgtcctgtgagatctctctgctcccccagaatctcatctctatgacatccctatcctggccctcccccaaccacgtttttctttgttgctggttctccaggaagcagacacctctcactcccgacaggacatgctggagtctggcctcggccaccagaaacgcttagcacgtcaccaaagacactccctgctccggaagcctcaggacaagaagaggcaagcatctcctcatctccaggatgtgaggctggaggggaatccaggggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaaggatgtgtgaaaaaaaaaggt

SEQ ID NO: 82813 - DNA, 623 bp, Homo sapiens
ctgcagcctcaggcccgggtgactccagcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttcctacgaggacccagctgggggcaaacactgtgagggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaaggatgtgtgaaaaaaaaaggt

SEQ ID NO: 82814 - DNA, 577 bp, Homo sapiens
ctgcagcctcaggcccgggtgactccagcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgaggaagcagacacctctcactcccgacaggacatgctggagtctggcctcggccaccagaaacgcttagcacgtcaccaaagacactccctgctccggaagcctcagggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaaggatgtgtgaaaaaaaaaggt

SEQ ID NO: 82815 - DNA, 1375 bp, Homo sapiens
ctgcagcctcaggcccgggtgactccagcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttcctacgaggacccagctgggggcaaacactgtgagcaccccatttctggcctggaggtactagaggctgagcagaacagcctgcacctgtgcctgctggggctgggccgccggctgcaggacctggagcaaggcctggggcactgggcattggcccagagtgggatggtgcagctgcaggccctccaggtggacctacgaggggcagctgagcgtgtggaggcgctgctagcgtttggtgaggggctggcacagcggagtgagcccagggcctgggcagccctggagcagatcctgcgggccctgggagcttaccgagactccatcttccggcggctctggcagctgcaggcccagctggtcagctacagcctggtgttcgaggaggccaacacgctggaccaggacttggaggtcgagggagactcggactggccaggacctggtggggtctgggggccctgggcacccagtagcctccccacttccacagagttggagtgggatccggcgggggacattgggggccttgggcccttgggacaaaagacagcccggacactaggagtgccctgtgagctgtgtggccacagggggccccagggcaggggacaaggccttgaggaagcagacacctctcactcccgacaggacatgctggagtctggcctcggccaccagaaacgcttagcacgtcaccaaagacactccctgctccggaagcctcaggacaagaagaggcaagcatctcctcatctccaggatgtgaggctggaggggaatccaggggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaaggatgtgtgaaaaaaaaaggt

SEQ ID NO: 82816 - DNA, 1196 bp, Homo sapiens
ctgcagcctcaggcccgggtgactccagcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttcctacgaggacccagctgggggcaaacactgtgagcaccccatttctggcctggaggtactagaggctgagcagaacagcctgcacctgtgcctgctggggctgggccgccggctgcaggacctggagcaaggcctggggcactgggcattggcccagagtgggatggtgcagctgcaggccctccaggtggacctacgaggggcagctgagcgtgtggaggcgctgctagcgtttggtgaggggctggcacagcggagtgagcccagggcctgggcagccctggagcagatcctgcgggccctgggagcttaccgagactccatcttccggcggctctggcagctgcaggcccagctggtcagctacagcctggtgttcgaggaggccaacacgctggaccaggacttggaggtcgagggagactcggactggccaggacctggaagcagacacctctcactcccgacaggacatgctggagtctggcctcggccaccagaaacgcttagcacgtcaccaaagacactccctgctccggaagcctcaggacaagaagaggcaagcatctcctcatctccaggatgtgaggctggaggggaatccaggggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaaggatgtgtgaaaaaaaaaggt

SEQ ID NO: 82817 - DNA, 1080 bp, Homo sapiens
ctgcagcctcaggcccgggtgactccagcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgaggccctccaggtggacctacgaggggcagctgagcgtgtggaggcgctgctagcgtttggtgaggggctggcacagcggagtgagcccagggcctgggcagccctggagcagatcctgcgggccctgggagcttaccgagactccatcttccggcggctctggcagctgcaggcccagctggtcagctacagcctggtgttcgaggaggccaacacgctggaccaggacttggaggtcgagggagactcggactggccaggacctggtggggtctgggggccctgggcacccagtagcctccccacttccacagagttggagtgggatccggcgggggacattgggggccttgggcccttgggacaaaagacagcccggacactaggagtgccctgtgagctgtgtggccacagggggccccagggcaggggacaaggccttgaggaagcagacacctctcactcccgacaggacatgctggagtctggcctcggccaccagaaacgcttagcacgtcaccaaagacactccctgctccggaagcctcaggacaagaagaggcaagcatctcctcatctccaggatgtgaggctggaggggaatccaggggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaaggatgtgtgaaaaaaaaaggt

SEQ ID NO: 82818 - DNA, 364 bp, Homo sapiens
gtagggcctttggaaagtaattaggattagataaaatcatcagggtggggccaccataatggggctggtggctttataagaggaagagagacctgagctgacacgcatgttcttgccctcttgctatgtggtgccctcagccatgttagggcacagcaagaaggccctcaccagatattggggtggtcttggacctcccaccctccagaactgtaagaaatagatttttttatatattacccagtctatgatattctgttacggcaacagaaaacagactaagacaagcttctaaacaaatggaaaatagagttttaagatgcagactttcattgccttaacagggccaagaatatctatttca

SEQ ID NO: 82819 - DNA, 119 bp, Homo sapiens
gcctccagagtcacgcagcttggagtcctggctgcagcccaggaagggtgagtggacggtgcagcacagcagacggcgcacaggcttggagtcgcccactcaggacaagtgtcaccttg

SEQ ID NO: 82820 - DNA, 381 bp, Homo sapiens
ctaggttatttatgatatctaatacaatgcaaatgctatgtaagcagctgttgtactgtattatttagggaataatgtcaaggaaaatagtctatatgtgttcaacagagacgcaatttttttcctgaatatttctgatccatgattgattggagtcatggatgtagaacccatgaatatggaggaccgctgtactaatcttgttgaggctctaggtagtcaaggaaaaaagacacataccacaatgtggaaaattatgattaaaagagtgcttcaaatcagtggagaaaagatgaattatttcagcaaatgattttttaataactggctagtcactgtgggaatccagaacaggaagctatatattccttactgtatgtt

SEQ ID NO: 82821 - DNA, 382 bp, Homo sapiens
aagacataattccaacacagcttccctatgaccactatttagaagtgtttagaggctgtgccgttaaagtgctgtgtgcacaacctcttgtgcaggtccaagaacattgctcatgatgtgggttgtcaagccagtgataccagccctcattccactataaatctcctgcctcagcctcctgagcagctgggattacaggcatgtgccaccacacttggctaattttgtatttttagtagggaccaggtttctccatgttgatccggctggtctcaaactcctgacctcaggagaatcgcttgaacccgggaggcggaggttgcaatgagccgagattgtgccagtgcactccagcctggcaacagatcaagactccatctca

SEQ ID NO: 82822 - DNA, 464 bp, Homo sapiens
ctcaaaacaaacaaacaaacaaaaaaaactccaactcattgatttattgctattgtctgatggagacatgggtgtaaccttaagaattttttttcatgattcattcagcctgggaaattggtaggaagaaagagaggatacccatgcatgtgagttttagagattatagaagcatcagttattatttttttcttcttggaagagacatgatattttacataggatgaaaaaagagaagctgtgtgtgtctgtgtgtgtgattttttttccttcctggaaaacacatgatacattttacataggatgaaaaaagagaagtgtgtgtgtgtgtgtgtgtgtgtgcgtgtgcttgtaacatttagcaaaatagtcattatctgagttttctgtgcagaagatgtaggaataataagtcatgggccttgccctcaaagggtttacagtctcttgaggtagctaagcat

SEQ ID NO: 82823 - DNA, 383 bp, Homo sapiens
aatggcatttaatacacctactgaatatcatagcttagcctagcctaccttaaatgtgctaagaacactgacattaggctatagttggcaaaaccatctaacacaaagcttattttgtaatacagtgttgaatatctcatgtaatttatttaatactgtacccaaagtgagaaacagaattgttgtatgggtactcaaagtgtgttttctactgaatgcatatggctttcacaccatcataaagctgaaaactcttaagtcgggacctggctgcactatgttctgctgcagcatctaccctccctctaagtaaggaggtgacttctcacttccgagcaacaaagacattcaggccagtgctgcctgctgatgggaaatgactg

SEQ ID NO: 82824 - DNA, 304 bp, Homo sapiens
tttatgaacaactttttttttttctcttagggcatctgttagatgcattccaagctccaggggagacctgtgtggaggtgcaagaaggaggagctctaaggttattttaatttagatttatctgagactccagaaaaatcacgtacgtggtgtggaaattatcctcacataggcagagggagaaaacactaaattcatattctacatgtatcttcttgtatcaagaccagtgttttcagaaatgagtttgccaataaatataaaaaccatccatcggttttcttcccaatactcattcttcccc

SEQ ID NO: 82825 - DNA, 351 bp, Homo sapiens
gtctcactctgtccccaggctggagtgcagtgacacgtacttggctcactgcaacctctgcctcctgggttcaagagattctcctgccttggcctccccaggagctgggattacaggcatgcgccaccatgcatggctaatttttgtatttttagtagagccagggtttcaccctgttggccaggctgatcttgaactcttgacctcaggtgatctgcccaccttggcctcccaaagtgctaggattacaggcgtgagccactgcacctggccccattcacagttcttaaactattatcaaagatgtcctacattcatgccccacccccacccatatgaaatcttgatctt

SEQ ID NO: 82826 - DNA, 564 bp, Homo sapiens
aagcatctctacctgcatatctgaaagttacctttaaataacatgtcaaaaatggaactaattacctatcatcatcctacaaacctgctcccctctcatatccctatttacattggtggtatcacaatttacccagacatctaggctggaaacctaaatgtattttccactactctttggcccttatggctatattcaatatatctaaatcagtcttcaagtcttattgattttatatctcacaaatctttctaatctgtctctcatctccattctcacctataatcacactttagctctggcctttagcatctcttgtcttgacttttacaaaagcaccctactacactagttctggtctcttgtctcatcccctcctacccattttgtataatgctaccagaatggtttttaaaaataaatctgaccacgtcatttctttccctaaacccttcaatgttcacactgcctaaaggataaaagtccaagatcctctctaacttgaacccttccctattctctggctttggctcctacacccccagcttgtattttaccagcaat

SEQ ID NO: 82827 - DNA, 1581 bp, Homo sapiens
actctgcgcacgcgcgccgggtgccccggcctaaggccgttgacctcgggttctccccggcacagtcgaatccacgccagggccctcaggccggtagctgtcctgcagtccgagcggagctgcgacctcgggcagctggaagcctgtgggctgctgcttctccaggcaggcggcggagggatgcaggcaggatgagcggcggtcccttcgccgccacccggagaaccgcggctggtgcccttgaaggccctgggatgcctgggttgggtgggtgggtgaacgagaaccctgagtgagtgaggggagggcgggtcccctcctggcttcaaattcaacccaatcagctctgccgatggtttgaaactgcacacgccgacccacccgccccgaagtctgaaagttatgccctggagacctgcgagctgcggagtgcagctggagagggagctgccccacgaggaggcctccagaataactcccggagtcggaacagcgctgggctgctgaagtttgcagcctccggatccgcgccccgccctgcagatccaccggatttcggggagggaatcggggggctgcccgtcctcccgtaaagctgacttgacaacaattacgaaagtttttaattagctccttgttataattcattttatttccagaactctccgaccataaattattcaaagagtaagccaacccgagcggggcggccgcgcgccttccccacgcgcgccgggctggctctggccgctcagctcacccgatgccccgtgagccagccccgcgccagaagccgcggtggcaggaaggtttgatcaaacattaaataacgtaatgtttgcgacaaggcttatctcacaagtggaaaagaggacctcgcgagaattagaattcggctgctattttaaaaaatcaattaagcttgcggtcttttttgaaacagctcgaaaggactgcgtggctatcatcgtggcgctaagactgagatggcaataacaccgatggcagaactgtaccagtattaattgtcatcacctttatcatcccgctggccaccaaggccgttcgaatggggtgggaaaggctagttttagccaggatcagaagccccagttccaacttcacggacgaaaaactgcgaaagcctatcaacttgaaagatgagtagggatacttcacgcaggtgccaggtgctatcaggagaggccggggcggcggggcagaggcagagggcagggatcgctgagtgagtcctgcgggcttggggcgccctgttctctcacgtgcgctgccacgtgtaggaggaactggaccgaagtagtctcagtatcacaagaaaacaaaaatcgatacaatcacggcagtgggtgcctacagtttatttatgaaactgtaatcgaagttgagagcaatttcagaacacgcattaaacaaaaattattcagaagttagttgatgggtcttgaggacataatttttttagacctacagaaggaacacgacctggagctagaactggggaaaagaggaaatttaagacaaatggatggcataaatgtggcagatgctttaatgcttatt

SEQ ID NO: 82828 - DNA, 539 bp, Homo sapiens
ccagatgtataacattgtaattttaaaaaatattttaatgatcatcagacataatttgcaatttgaatccaactctgaacaagaacaaaaatgaaaaaacccatctcttaaacagagctaggctactttaaacacaggaataaggcaaatgccctactcagtaatgagaagctcctcatgtaactgtttctacaacatagctatcaccaggcctgaattcttttgggctcagaatttgttctaagaaatggctattattaaaaagtcaaaaaataacagatgctggcgagcctgtggagaaaagggaatgtatatacatttctggtgggaatgtaaattagttcagccattgtagaaagtagtttggtgatttctcaaataacttaaaacagaattaccatttgacctagcaatcccattactgagtatatacccaaaggaatataaattgttctaccataaagtcacatgcacacacatgttcagtgctgtactattcacaatagcaaagacatggagtcaacctatatgcccatcaa

SEQ ID NO: 82829 - DNA, 344 bp, Homo sapiens
aaaaggaattttttttttcagggaggagaaataaacaactgtatttcagaatgactgttttagtaactctcaagtaggtaactcatatgaaaataacccaggagaaatacccgtgatagcccaaaacattttagttgaaggggaaaaaatacacatctaaaggaaaaaaggaatctgtctatccaaagctacagcctaaagacaaaagagacattgcattccttcatggccacagaaaaacctgtgcattcaggggcactccagatgaggagcagccaagatgacaatgctttacagtggtgatgtttattaaaaggcccctggatgcaatagaaggatctgtt

SEQ ID NO: 82830 - DNA, 682 bp, Homo sapiens
agtaaatgtattatttaaaatgttttctttggaagcatatttttataatctcagggaggctcatccccattttatagaaatccatattacagagtactagaaggaataaaatgataaggtaagtccttgtcttaaggaatttacagggtaaatccaaaagtgaaaaaatattttttcatggatataaatattttgattgtaacttctcttcttattaaaaagggcacagtggctcatgcctgtaatgctagcactttgggaggctgaggtgagacgatcacgaggccaggagtttgagactagcctggccaacatggtgaaacccctctctactaaaaatgcaaaaattagccaggcatggtggtgcacacctgtagtcccagctacttgggaggctgaggcagaagaatcgcttgaacccaggaggcggaggttgcggtgagccgagatcacgccactgcactccagccagggtgacagagcgagactccgtctcaaaaaaaaaaaaaaaaaaaaaaagtagtatataattcaggaaggaacacgctattctttctcaggctttattaatcatgtttaaatctgcctatgtaactgcactacacactcatgtgtgcttactatgtgccagggacttactaaccataatacaaaaattaatttatttaatcctcataataac

SEQ ID NO: 82831 - DNA, 791 bp, Homo sapiens
  misc_feature (607)..(607): n is a, c, g, or t
  misc_feature (708)..(708): n is a, c, g, or t
  misc_feature (773)..(773): n is a, c, g, or t
  misc_feature (783)..(783): n is a, c, g, or t
cacactggggagaggccttatgagtgcagtgaatgtgggaagttctttccctacagctccagtctccgaaaacaccagagagttcacactggatcaagaccctatgagtgcagtgaatgtgggaaatcctttactcaaaattccggcctcattaagcacaggagggttcacactggggagaagccttatgagtgcacggaatgtgggaaatcctttagccataactccagccttattaaacatcagagaattcatagtcgataaaagccttatgagtggcaaatgtggaaatctgttagcaccctggagaaagtccttgagtacacagtgaatgtcagaaagcttcagctgaaggccatatctcattgagtgccacacagttcacaagggaaagacacttttgatatgtagggatgtccagttgatataacagctctgaaggagatcccttatgagggtggcatcagcctgaattgaacatcctatatctgaacatctgcataaatccaggtatgtgtgaactgcattgcaccttttgccctgcccagggcccatgtcagatttatgtctctgctgatactatagtggaagccattttacctctacngcctggcaggtgaccaccagtgtgcaccactcacccatcccagtgtattcaggtaagtgaaccttggtgttctgttcatgggaggaatttgtaaatagccnaagcatttattccgttttttttttttcctttctgatgagttaggccatggacctgacccagtttngccagaggantctgctgg

SEQ ID NO: 82832 - DNA, 616 bp, Homo sapiens
cgaaggggaagaaaagctgtatcgattgttgagatctggcgacttgtttaaatttcatcagcctcacttctatgaactctcaggcctcacgtgtaccagctctctgctctcctttgccttgggacgttccatccctggaagtttccctgcccacatctttgtagagagtccattctccaagcttcagtgtgtcatctgtgaggaccgtgacccacctggtacatcgcctcagggcattcatttcaggctccttctaaatggccaagagacaacaccaacatttttgtaatggcctgcaaggccttccgagatctacctcctgcaactcagcttctcctgtgctctccttctggactcactctgcctcagcaacactggtccctgttgccccaccaatatgccaggccatgagagaagcagtaccttataatggttccttgttcaaagcactcaatattcctaggatgtggtctcccagctgacttcataactgaatcatcagtaattaatttcattgttctattaggactttactgaagactctaaggaggacctgtatctgttgggatcctcagggcaagccacagaaacaagctttggatactagaagcagaaa

SEQ ID NO: 82833 - DNA, 2872 bp, Homo sapiens
ggttcttttccaaacttgttccctggcttccaagtgacgaaaccagctgtaatttgagagcagagagatcctcaggatatctttagccaaaggaaaagctccgcattcccacccagtccagaaattgaaatactatcagggggcaagagcctttctctccagctacacactccatctcccgggacaagccagctgggactgaggcggacgctgtctcagggagacgctgactcgcaaagacactcccttccttgtgcctgggtaaaaagtctcctcctggggtccctggccatcctgaatatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtcggctgaaaaatgattatcttaaagtataggtggaaggatacaaatgctagaaagagggaatcaaatcagccccgttttggagggtgggggacagaagatggggctacatttcccccatacctactatttttttatatcccgatttgcactttgagaatacatctaaggtcatctttcaaaagagaaaaattggacacttgagtgactttgtttttagttttgtttttgtacattatttatgtgattgttatggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcatgtaatactggcttactttgtaatttacatctgtaactttcatatttctaaaaggggccaatgcaaaaggagagagaaggactggatttaagccagtttacttagagtatatgataaagaaggcagaggaatagctacatatttggcaattctcctctctgtagtcaccctgacatcctcacaagaaaacaaatctagccattgcccaaactttaaatttgatctctataggtctgcttaaagactcaaattttctccagtttctctcataaattcaattgcaaaagtttctgacaaggctcataccctgtacccttatgcagagcaagcattccatcctaagttataaactacagtgatgtttaattttgaagccaggtctacattatttaattaatggcttcaaaaggtggagatgcactttatttaatgtctttccctagctaattcttactctcaccttaaatatgctttcttgttgcatatatgcacagatacacacacacacacacacgaaaataaataaatgttcatattcttctgttcaacagacatttattttctcctctcccttgaataagaaaataagttttccattcctatgaactgtctaatatctttctattacagaaggggaaactgaggctgggaaaggctaaatgacttatcctccatcagttataacagcccctggtcttcttaaatttaaacacgggacttcccgaactaatttttttaaggatactgaaaaatgagagagagtggtcgaatgcctgaaattttgcttaacttactgtacttaaaatcaattataacttctttttgttactcagggccccactttttgttgctttctagacttgtgtgtagaaagaagattaatgatcacttaaagtagtttccttctttattctgaaaaaatgaggaaaaaataacaacagtggcaaataaaatcatatttggtactaaaaaaat

SEQ ID NO: 82834 - DNA, 1305 bp, Homo sapiens
ggttcttttccaaacttgttccctggcttccaagtgacgaaaccagctgtaatttgagagcagagagatcctcaggatatctttagccaaaggaaaagctccgcattcccacccagtccagaaattgaaatactatcagggggcaagagcctttctctccagctacacactccatctcccgggagcaaggggaaactccgagaggagggcaacagagccagcatcttgccaggccccggaggaggggttccccgctacgcctgtgccggaggagttccagtcaccgagcgaggggcgcaagggtgggtgcatcctgcgctgcggcgggcgcgctacccagacgctggtgtgcagagccacatgaagcctgctggggactgggggccagggagcagcaagccagctgggactgaggcggacgctgtctcagggagacgctgactcgcaaagacactcccttccttgtgcctgggtaaaaagtctcctcctggggtccctggccatcctgaatatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtcggctgaaaaatgattatcttaaagtataggtggaaggatacaaatgctagaaagagggaatcaaatcagccccgttttggagggtgggggacagagaagtgacagggaagctacaggttacaacagatttgtgaactcagccaagcacagtggtggcagggacccactcggggtaccgag

SEQ ID NO: 82835 - DNA, 3083 bp, Homo sapiens
ggttcttttccaaacttgttccctggcttccaagtgacgaaaccagctgtaatttgagagcagagagatcctcaggatatctttagccaaaggaaaagctccgcattcccacccagtccagaaattgaaatactatcagggggcaagagcctttctctccagctacacactccatctcccgggagcaaggggaaactccgagaggagggcaacagagccagcatcttgccaggccccggaggaggggttccccgctacgcctgtgccggaggagttccagtcaccgagcgaggggcgcaagggtgggtgcatcctgcgctgcggcgggcgcgctacccagacgctggtgtgcagagccacatgaagcctgctggggactgggggccagggagcagcaagccagctgggactgaggcggacgctgtctcagggagacgctgactcgcaaagacactcccttccttgtgcctgggtaaaaagtctcctcctggggtccctggccatcctgaatatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtcggctgaaaaatgattatcttaaagtataggtggaaggatacaaatgctagaaagagggaatcaaatcagccccgttttggagggtgggggacagaagatggggctacatttcccccatacctactatttttttatatcccgatttgcactttgagaatacatctaaggtcatctttcaaaagagaaaaattggacacttgagtgactttgtttttagttttgtttttgtacattatttatgtgattgttatggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcatgtaatactggcttactttgtaatttacatctgtaactttcatatttctaaaaggggccaatgcaaaaggagagagaaggactggatttaagccagtttacttagagtatatgataaagaaggcagaggaatagctacatatttggcaattctcctctctgtagtcaccctgacatcctcacaagaaaacaaatctagccattgcccaaactttaaatttgatctctataggtctgcttaaagactcaaattttctccagtttctctcataaattcaattgcaaaagtttctgacaaggctcataccctgtacccttatgcagagcaagcattccatcctaagttataaactacagtgatgtttaattttgaagccaggtctacattatttaattaatggcttcaaaaggtggagatgcactttatttaatgtctttccctagctaattcttactctcaccttaaatatgctttcttgttgcatatatgcacagatacacacacacacacacacgaaaataaataaatgttcatattcttctgttcaacagacatttattttctcctctcccttgaataagaaaataagttttccattcctatgaactgtctaatatctttctattacagaaggggaaactgaggctgggaaaggctaaatgacttatcctccatcagttataacagcccctggtcttcttaaatttaaacacgggacttcccgaactaatttttttaaggatactgaaaaatgagagagagtggtcgaatgcctgaaattttgcttaacttactgtacttaaaatcaattataacttctttttgttactcagggccccactttttgttgctttctagacttgtgtgtagaaagaagattaatgatcacttaaagtagtttccttctttattctgaaaaaatgaggaaaaaataacaacagtggcaaataaaatcatatttggtactaaaaaaat

SEQ ID NO: 82836 - DNA, 3029 bp, Homo sapiens
ggttcttttccaaacttgttccctggcttccaagtgacgaaaccagctgtaatttgagagcagagagatcctcaggatatctttagccaaaggaaaagctccgcattcccacccagtccagaaattgaaatactatcagggggcaagagcctttctctccagctacacactccatctcccgggagcaaggggaaactccgagaggagggcaacagagccagcatcttgccaggccccggaggaggggttccccgctacgcctgtgccggaggagttccagtcaccgagcgaggggcgcaagggtgggtgcatcctgcgctgcggcgggcgcgctacccagacgctggtgtgcagagccacatgaagcctgctggggactgggggccagggagcagcaagccagctgggactgaggcggacgctgtctcagggagacgctgactcgcaaagacactcccttccttgtgcctgggtaaaaagtctcctcctggggtccctggccatcctgaatatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtcggctgaaaaatgattatcttaaagtataggtggaaggatacaaatgctagaaagagggaatcaaatcagccccgttttggagggtgggggacagaagatggggctacatttcccccatacctactatttttttatatcccgatttgcactttgagaatacatctaaggtcatctttcaaaagagaaaaattggacacttgagtgactttgtttttagttttgtttttgtacattatttatgtgattgttatggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcatgtaatactggcttactttgtaatttacatctgtaactttcatatttctaaaaggggccaatgcaaaaggagagagaaggactggatttaagccagtttacttagagtatatgataaagaaggcagaggaatagctacatatttggcaattctcctctctgtagtcaccctgacatcctcacaagaaaacaaatctagccattgcccaaactttaaatttgatctctataggtctgcttaaagactcaaattttctccagtttctctcataaattcaattgcaaaagtttctgacaaggctcataccctgtacccttatgcagagcaagcattccatcctaagttataaactacagtgatgtttaattttgaagccaggtctacattatttaattaatggcttcaaaaggtggagatgcactttatttaatgtctttccctagctaattcttactctcaccttaaatatgctttcttgttgcatatatgcacagatacacacacacacacacacgaaaataaataaatgttcatattcttctgttcaacagacatttattttctcctctcccttgaataagaaaataagttttccattcctatgaactgtctaatatctttctattacagaaggggaaactgaggctgggaaaggctaaatgacttatcctccatcagttataacagcccctggtcttcttaaatttaaacacgggacttcccgaactaatttttttaaggatactgaaaaatgagagagagtggtcgaatgcctgaaattttgcttaacttactgtacttaaaatcaattataacttctttttgttactcagggccccactttttgttgctttctagacttgtgtgtagaaagaagattaatgatcacttaaagtagtttccttctttattctgaaaaaatgaggaaaaaataacaacagtggcaaataaaatcatatttggtactaaaaaaat

SEQ ID NO: 82837 - DNA, 748 bp, Homo sapiens
gtgggctccacccagttcgagcttcccagctgctttgtttacctaatcaagcctgggcaatggcatgtgcccctcccccagcctcgctgccgccttgcagtttgatctcagactgctgtgctagcaatcagcgagactccgtgggcgtaggaccctccgagccaggtgcgcgatataatctcgtggtgcgccgttttttaagcccgtcggaaaagcgcagtattcgggtgggagtgacccgattttccaggtgccgtccgtcacccctttctttgactgggaaagggaactccctgaccccttgggcttcccaagtgaggcaatgcttcgccctgcttcggctcgcacaaggtgcgcgcacccactgacctgcgcccactgtctggcactccctagtgagatgaacccggtacttcagatggaaatgcagaaatcacctgtcgtctgcgtcgctcacgctgggagctgtagaccggagctgttcctattcggccatcttggctcctcgatcctgaccatcacttcccccttgtgtgaaaatcttggaatctcatgttcatatggcggtgccaaacaattgaagcagcctgcaatgctgagtgtacatttggaggacaactgttatggagagctgcccagacctagaatggatttttacaacaggaaagtaaatttctgatgatgcagatgattaaaaagatgatcatgaagacacactctttaaatgactggggaaaacatcagacca

SEQ ID NO: 82838 - DNA, 712 bp, Homo sapiens
ctaaaattggaatgatacagagaagattagcatggcccctgtgcaaggatgacacacaaactcatgaacaattccatatttttaacaaaagaagtaaaaaataataataacacctttctaaaaattacttgttagataaaacaatgcatataaagcatctagcagagtgcctgggacatgataccccctcaataaatggtacctatttttattttctgtggaatgaatgaatgaaaaaaaaatggcttaacgaagcataaaaaacatcaggttgtgacaatctttacaatttaattactgtattataataattactgtattataagtgagctatgattatgccactgcactccagcctgggtgacacagcaagagacctcgactctttaaaaaaaaaaaaatactgtattatatggtaacaaatagaaccactaggttatttctatttatagaatgaatttttattttcaaataaactctaactggcttcattttagacatgtagcaactgttgaattaaagagttcactatattaaaaaataggcaaagttttattttggtattatagtaatctcaaatgtatcttgtaaaaaaattaatgttttcactccagttaagtatagtatatattgctccttcataattataagtctataagttatcttatcccttaggtggtactgtagcaatcatgagattaacaaaataggc

SEQ ID NO: 82839 - DNA, 408 bp, Homo sapiens
gagatcttgtcccagctcccaaacatgaattaggacatgaggctcactgctttggaaagccctctaatttttctgcttgttcccagcatgcctcaatcttggggtttggcctagaaggaaagtcatatctgcctgcttgcacttcccctccctggcctcttcttcctagttccccaccccactgcctccctaggctggaggaaacatactctctgtcatttgctgagtgttcactaccaatgacttataggaaaacttgacattcagacctccaaagttttcttttgataggtacaggtaatttttggaatttataaattcctctttgctcccaacaaatactgtgcttcaagattttgtctaagcttgccaaaatggccccaactgagcagtggcttctcaattcta

SEQ ID NO: 82840 - DNA, 483 bp, Homo sapiens
taaacttggcaactgcttttatgttctgtctccttccataaatttttcaaaatactaattcaacaaagaaaaagctctaattttcattggaaataatttatatacttgtttagagcagagaaaaattaagaaaaactttgaaatggtctcaaaaaattgctaaatattttcaatggaaaactaaatgttagtttagctgattgtatggggtttctgaacctttcactttttgtttgttttacctatttcacaactgtgtaaattgccaataattcctgtccatgaaaatgcaaattatccagtgtagatatatttgaccatcaccctatggatattggctagttttgcctttattaagcaaattcatttcagcctgaatgtctgcctatatattctctgctctttgtattctcctttgaacccgttaaaacatcctgtggcactcttatttattaatcagttaaataaaatcatgaacatata

SEQ ID NO: 82841 - DNA, 487 bp, Homo sapiens
gtggcttccctggcttttggactcagactggggtttcactgtatgtttccctgattctcaggcctttggacttgaattgaattacagcatgaactttcctagttctctagcttgcatatggcatattgtgggacttcttgacctccataatcatgtgagctaattcccataataaatctcctcttatgtatctataattcatatagatatgatatctatatatcaatcccatagataaatagatgtctcatatatatatcaatgtctctatatgtagatgtctcatatatggtatctatgtatctgtatcatctctatatatctaatcatctaatatagatgtctcatgatatctatatagatatatctatatcatagatgcagagatatcatatatatgtctgtttctttggagaattctgactgatacaggttgcttccgccttttggctatcatgagtaatgccgctgtaaccatgggtatgca

SEQ ID NO: 82842 - DNA, 583 bp, Homo sapiens
cctcagtctcccagagggtggcgacccccgcgtcccgctccggcaccggcgggaagagagcgcctcccggaatctggtgggcaaagagggcggctccttacgtaggcgggcagagacagaagctggcgtggccgggctcctgctcccctattctccgacccccgccacctagcccgcgccacccagggctcctggatcgtctggctcggggcctcctccccgctgcgttccctccctggcggctgcagagccctcctgggcagcggaaacaaacttccccgagcaggaagcccgtgccccagcctcctctcggcaaggaccagcccgcggaacaccccggcccctcggcgcctgccctgtccttctggctacgggtccaggagggctggcatgagaccaatcgcgaccctgcggttccagagcctgcgtcccgcactgccgagaccacacagtctcctctcttaggagccttgacatggccctcttgacgggtggttgggggaccagggtgtgtgtatatgggggacagttggtcaaaagtggctttttgtttccccaaaaataaagacccctttgaaattta

SEQ ID NO: 82843 - DNA, 1025 bp, Homo sapiens
actccttcagttgtcctgtgagctgggcgttgcagtccgctcgaatcaagtgttggaaaccccccaccccacccctcagcccatcgtgaaacgacagctgtcagcctggggggtggctgctgaggaggtgcagcaggaatggggctgggcccttaggttttactttccaagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggtagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaatgcgcgcaccaggaccgaggggagctccctccccacatctgctgcgaattgccagcttttaaatggatggggttttttatgggttgaacctctgttaatacttttgtacactctcactacagtttatatttttataggctattttctcaaggtgtttctagattccacatatctattttatataacaagttcttatgttatgtgtgtgactcccttgtgtgtatctgtgccagcctcagcctccgagttgcttttccctctggcc

SEQ ID NO: 82844 - DNA, 277 bp, Homo sapiens
acgtgctaggttgtctcacatctaggaaagagaatgttcatattatatagaaatgggcattttccctgtggcctgatatgaggtatccagaatattcctttaggtattattaagtcataggtttctgttttgatagaaacagcaggtggttcagttagtatttttgttgttgtaatagtagcttagatctcttgtttttgttttctttggccaagacagaaaacattctgccacacacattacttcatgactctggttatatattgagagcagcatt

SEQ ID NO: 82845 - DNA, 692 bp, Homo sapiens
aattcttgttagtattacaggttgagcatccctaatctgaaaatctgatatctgaaatgctaaaaaacccagaactttttgagggccaacaggacaccacaagtggaaagttccacaccttatgtgatggggcacaaagtgtaggggcacaacacatagtttattcagtgtccctaagggaaaaagactctctcaaccccctttagccgtgatatatctttgtatacatgcatagtatattagtcctcgcattgctatatgcattctcgcattgctataaagaactacctgagactgggtaatttataaagggaagagttttaattggctcacagttctgcaggctgtataggaaacataactcggaggcctcaggaaacttacactcatagtggaaggtgaagggcaaacaagcacgtcttatgtggccagagcaggaagaagagagagaggtgggaggtgccacacacatttaaacaactacatttcttgagacctgtgtcacgagaacagcaccaaaggggggaaatcagcccccatgatgcaatcacctcccaccaggcccacctccagcattggggattgcaatccgacatgagatttgggcagggacacgaatccaaaccatatcacctagattccctcacacaagtactccctcaaaggacaatatacaaatattccaaaatctg

SEQ ID NO: 82846 - DNA, 1224 bp, Homo sapiens
  misc_feature (820)..(820): n is a, c, g, or t
gtgcgcgcctgccttgaggccaggcctcagagaagggtgtcccagatgtaggcaaagcgtcctccatgtgttcctggaggaccgtcccaagtccttctccattctcccaacctcttgggcctggaagtcagacaagtaccggtgattgccggtttcttgtctgatttttgcacttctctggcaagctgccccctctgaagagttgactatttgggagttactcactgatggttcagccacttccagaacctaccccaagagcaagacttgaaaccaactcgcaccctcaaagctccggaagccattcagtgtttccatcttggctgagtgagttcttcactgaaactcaatttgactttgacagtcatctaatgagaactcaaaagtcattcttggttcagccacagtcaaagaacttgcagagcattctctgacgaggtcctcaaggacaactgagagaaggtcccattccaggtcttgcccaagtctttctgattggtgggacttaaatcacacccaaaattccagctgcaggagagctctgagatttcatctttccaacctctgtgtgctacgtgggggttggagcacttgctgacaagccttgcaaccaccattgacaggatgtcctccaccttttcaatctgatttgctctttgccatgcagacctgtggatgaagagccagagtcctccaaggtgaagctggactgaatatttctgtccataagactattagaatcccccaaagtgggataccagtgaggacctcaccagcagctgctgtctctccaatgcagggcaaggaaggactgtgcatngagtgtttcatgctgcggtggctcctccagtgtttcattgatgggagtgcctcatgaagccttccctggagcaccatctgggagtttcaggagcgactttttcagagctgggccccggagggacacgtggtcctcaagaaccttcaaaactccgtgaaggactccccaggaaaccctgggactggcacccccagtgcaggcagtctgcacccggaggcctggccaaaaggccccggtggcctaagtccactatgccaactgtgtgcccccggagggttccgaggccttgcttggttgcaccacccggccttcctgagggcgttggttcttgcagccttaaccctggccgaggccacggcgggccccattgccaattgctttccagccgggtttcccgatgggca

SEQ ID NO: 82847 - DNA, 885 bp, Homo sapiens
  misc_feature (481)..(481): n is a, c, g, or t
gtgcgcgcctgccttgaggccaggcctcagagaagggtgtcccagatgtaggcaaagcgtcctccatgtgttcctggaggaccgtcccaagtccttctccattctcccaacctcttgggcctggtcccattccaggtcttgcccaagtctttctgattggtgggacttaaatcacacccaaaattccagctgcaggagagctctgagatttcatctttccaacctctgtgtgctacgtgggggttggagcacttgctgacaagccttgcaaccaccattgacaggatgtcctccaccttttcaatctgatttgctctttgccatgcagacctgtggatgaagagccagagtcctccaaggtgaagctggactgaatatttctgtccataagactattagaatcccccaaagtgggataccagtgaggacctcaccagcagctgctgtctctccaatgcagggcaaggaaggactgtgcatngagtgtttcatgctgcggtggctcctccagtgtttcattgatgggagtgcctcatgaagccttccctggagcaccatctgggagtttcaggagcgactttttcagagctgggccccggagggacacgtggtcctcaagaaccttcaaaactccgtgaaggactccccaggaaaccctgggactggcacccccagtgcaggcagtctgcacccggaggcctggccaaaaggccccggtggcctaagtccactatgccaactgtgtgcccccggagggttccgaggccttgcttggttgcaccacccggccttcctgagggcgttggttcttgcagccttaaccctggccgaggccacggcgggccccattgccaattgctttccagccgggtttcccgatgggca

SEQ ID NO: 82848 - DNA, 402 bp, Homo sapiens
aaaggaaaaaaattcccattattatttccttcaaccccctctaccttctatgccaccattactcaaaagtcactcaaacattttgctggctgacatgacgccacgctgtcacttgatcaggtgtggagtaccacatggaatgaataaatacttatccacaaccgcatattaaatgggaattcgcacaggcgggctctggagacaaagacgtttctatacagaaatattaactaagaatttaagtaaatggccccactggaaaaaaaaaaggtctgaagtagcaatataaactatatttaatagcaacaaaaaatattttccttttgggaaagcaatttgggcttctaaaagttactgcctttcacgtgacttagtacagtatgcctgaattctttcatttcc

SEQ ID NO: 82849 - DNA, 356 bp, Homo sapiens
cactaagcctctaaagtaccacctctaaaggccactcagctactgggtgacaagctgatcacatcagaccccttccatcctggaaggggaagtgctgaatctggtcctaaataaaagttgcctttcctgcccacagaagctcagccacagccccaacgcccaaaggctcacagagtatttgattgaacgggacagggtaccgagaacatggcattaaacaaagggacccgctttatagcagaggacgtgccacaatgggcgcatgactgtgagatccactgggcctgccgtatcctccaacacccagaaatgccagcctgatggagcaatggaggggggagccacagtgccagctg

SEQ ID NO: 82850 - DNA, 357 bp, Homo sapiens
gttgagtctagaggatccctggccaggctctctactaattctttctttctatctatctctaggcatccaaaatctatctatctatctatctatctatctatctatctatctatctacacctatctatatcaaatctatctatctatctctatccatccaaaatatatctatctatccatctatacctatctaaaatctatctatctccatccaaaatctatctatctatctatctatctatctatctatagcactccaccatagaaaaggataaaatcatgtcctttacagcaacagaactggaggcgattattttaggtgaaataacccagaaacagacagccaaataatgtatgt

SEQ ID NO: 82851 - DNA, 138 bp, Homo sapiens
gttttaaacaaccagatctctcaggaactcattgttgttagaaaaggaattaaaagaaatcaaagagtgtgtaagcagaaactcagttgtacgtaagaaaacccaattccccctgagaaagagaaagagctggagtcc

SEQ ID NO: 82852 - DNA, 933 bp, Homo sapiens
caaccacggaccagcacctcaaggaagaccacctgttgcagctgatttcctgcccaggtggaagttgttagaaaggttgggttcatcttcctcaggacttgcgtggtgcttctggcacccaacacaaacatgggagcatcctcggaaaagggacttaaaagcagtgaatctcagctgaagtcaagcagatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacacccatctacaggtgagccact

SEQ ID NO: 82853 - DNA, 301 bp, Homo sapiens
gatgaaatattttaaagctaaataccctgagactctcactatagtattttttaaatgtcaattatatgtgagccttttcgtttatttacctgatttgtcttaaaaaacgatgtataacttctttcacactttgaaaatttacctgaaggagtagatatatacgtggttcttgttctgccctctggagcaactgagatatactctgtcttacatatgactgcctgtcagatagctgaagatagtcattacccacagagaaggaagacatcagttctacataaggaagtgttctgtagataag

SEQ ID NO: 82854 - DNA, 613 bp, Homo sapiens
tgtagagacaggggtcttgctatgttgcccaagctggtcttgaacccagcttcaggcaatcctcctgccttggcctcccaaagtgctaggattacaggcgtgagccacactgcacctggcctcaaactgccattgttttaggcttctctaattacacattttaaaatgtataacctttctctggcagaatatatgggctgcctatttacaacagatgtatctattaaatcttcagaattttttctactcatatagaattttaaacatcttcattaatatatttctttctctatttatatcacattgtatgcatatatgtaaccactggacttttttaacttaagtaatcaggaggttgagagttccgcacagtttgcataaatatggtgtactggataggaatgtgggatctggaattcaggagacatagactgcaatcctggctatcaaatttgctagttatatgaccttggtaatttacttaacctctctgttcctcacatcctcatttataaagtggctataacacctaccccatagagttgaataagaaatgaagaatacaaaaaacactcttagcacagagtatagcatgcatatagcaaatactaaa

SEQ ID NO: 82855 - DNA, 515 bp, Homo sapiens
gctcatcataggggaaacctgctgctacatcatgagatagccctgtggaaaggtccacatgagtgaactttgaagcatatcctcccccagtttagcctttagatgaggaccacagccaaatagcttgactgtaagccagatagcttgactcatgagggaccttcagccagaggcatcttttgagccatacgaattcctgacccatagaaactgcaagacaataaatgttgttttaagttgctaaattttagggtaatttgttacacagtaataggttaataatacactggcccagattaggaaggttctgccatccatcccagccatcccaaacaactaccagaataatggattaaaacgttaactgttttaagtcactaagttttgggcagcatgataacaacccagcaaaaagctaactgatacattgattatttattgcatttcttcctccactattcttctctaacagatgaccaatactaataaactactgtgaacactttcatgtttta

SEQ ID NO: 82856 - DNA, 673 bp, Homo sapiens
tgcagttttgtgaataagctgtagggggtaagtatagtaatggggagatcaattagcaggctatatcagtcgtctaggtgggagatactcatagtttggaccagggtagttgcagttgatgtggggagaaattgtcagttttgagatatatatttgaaggtagagccatcaggatttcccgacagattggatgtggattatgagagaaagtatttttcctggcgagtggtaggatggagttacagttagctgagataaggaatatctcgagtgaagcagtttccagggagagatcaggagttcagttttgggcatattaacctttgagatgtctaataacagacatctgagtagacatgtcagttaagcagttggtataggaatgtgaagttccatggagaagtttgggctagaggtacatatttgagaatcagttcatttggatgatattgaaagccatgagactggatgaaattaccaagggagggagtgtagataaaaaaagaggtcccaggccaggtgcagtggtgtgagcctgtagtccctgctactctggaggctgaggcaggaggatctcttgagcccaggagtttgaggctgtattgtgttatgattgtgcctgtgaatagctactgcattacagcctgggcaacagaatgagactttgtctctt

SEQ ID NO: 82857 - DNA, 377 bp, Homo sapiens
aaaaactgcctctgtgccatgtgcatttaaaggagttcctcaagtgtttttaatgccaacacagcccttttctagggttcacatgtatttactttttttaagaggcaaggtcgctaggagtgcgtgcgcggcctgaattttctacataattctattactgtaggaaaaaaaactccatctcagattttcaggatctacttgaaaaacatacatacatatatattttttgagacagcgtcttactctgtctccaaaaaataaaaataaaaacataaaatgtctagtgtggctggaagaggcagattacacctgtaatcacagtactttgggaggccaagatgggaggactgcttgaacccaggaatttgagaccagcc

SEQ ID NO: 82858 - DNA, 643 bp, Homo sapiens
ataccacaggtgtcctagattgtcaacagaccatttaatcatttttgttaacaaagcaggtgacaattgagccctaatttgcgttatcattagttgttacaggatcttgcttgttctcctgaggccacgccacgatttccgagaagcaggttgcacactcagcagtctcccactagccagtggcactgcaggtgcaggggctgcctcctggacctttcaggacgctttgcaaggtcactgaggatctccattgcacatttggtagaattaaaagactgccagactcagtcttactgttgttagtgtattcgtgctgtcaatatgtgatgaggacatattatattccgttattctctttagctcaaggaagaataaagaatttggaccaaaattacaaccacattatgacgaattttctaagcaaaagaaacaaagtaactgctgaggttaacaaagatgtaataattctcttcacacagccttgtactgttttattgactgtattatcacaaatcctgagcttaacgaaagtctttataagtcagctcatgaaaacaggcacgtggccagtaagaatttaatttcataccaataacacttcagacttcggatgtatttaaggctgtttgcacatatttataga

SEQ ID NO: 82859 - DNA, 455 bp, Homo sapiens
catctgttctaaaaactcagattgggctgggcatggtggctcacacctgtaatcccggcactttgggaggccgaggcaggtggatcaccggaggccaggagttcgagaccagcctggccaacatggtgaaatcccatctctactaaaaatgaaaaaattagccaggcatggtggcaggtgcctgtagtcccagctactcgggcggctgagggagaatctcctgggagatggaggttacagtgagctaagatcgcaccactgcactccagcctgggcaacagagtgagactgtctcaatcaatcaatcaatcaatccatcaataaatataaaactcagcttgaagccctggctaccctgtgaagtcttcactaccatccagcccctggaattcattccattttgtcaattccaggaacatatattttactatatacctgtgctacccaatacagta

SEQ ID NO: 82860 - DNA, 585 bp, Homo sapiens
ttcaaagcgaacaaatcagtggcaggtagcacattcacagtgctgtgcacgcaccacctctatctagttctaagacgtttccattgcccccaaaggaaccccgtatctgttaaacactcactcccacaggcccctcgcaacccccagtcagcttctgttatttgcccattctggacatttcatataaatgggatcattttataggtgaccttctgtgtctggctggaatgttttcgaggtacacccatggcatagcacagatcaggactttgctcctttttaaggctgaatcatattcccaagtatgaaaataccgcaactgggccgggcgcggtggctcacacctgtaatcccagcactttgagaggccaaggcaggtggatcacctgaggtcaggagtttgagaccagcttggccaacatggtgaaatcccgtctctactaaaaatacaaaaattagctgggtgtggtggtacacacctgtaatcccagctacttgggaggctgaggcaggagaattgcttgaacccgggaggtggaggttgcagtgagccgagatcgagccactacactccggcttgggtga

SEQ ID NO: 82861 - DNA, 343 bp, Homo sapiens
gggagggaagcccagccatggctgatgcgtggtgggacacgggggcctctggtgtggtcagaaggaatttgcacaagtggtttctggccggaccgtttccttggttttgttgctgtgtaaataagtcgtgggaagcacaactgtacggcgtctacctttccttgctgttcgtgaccatctgccctgctggggagagcttgggatgttgcagagcctttaggaacaggcggtggtcacaagggcctcccctcagcattggttgcaaaatggacctgagttttccagtaaagtcctgaagggtagcatgtgaggctcaaggatgacccctgggcagcctgccagc

SEQ ID NO: 82862 - DNA, 528 bp, Homo sapiens
aacaacaataaaaaggcaaaaaattctatcagaagaactgcaacagaacaggagatggaattccagggaagtaccagacatttctatcagagcaagacttggaggttggacaagccctctgaaagttactcccttacaacctcatcatgaaggacgctcattaagtcacatatttacatttgatgaggaggcaacatgtacagatgaaggtgaaccacttgttcaaacaaacaagaaatgtaatgcaaaggactcattttacaagtcctctacacaaaaagcttatgaagatgttccttgggataagatgctaccaccaaaacttgttccagaagaaacaacattggaaaaaaccgctgaccccatctcacagtgttttactctgaaaagatataaaggggtgccagcaataactcagatggttggtgagctctgggacagatttcaaacaagatctttcttggcaccagtcaaaccaattaattttgtgagttcaagttctagaagtaaatatattcctctctatac

SEQ ID NO: 82863 - DNA, 502 bp, Homo sapiens
gtattttcccagacaggaaggaagaattaaaactagttacaagtttacaagttagaaagaaaacttgtaaaaacttcctctggtatatactaagcaaaattttataatctgttagtttttgaaaaacacatttttcatttttacatcatttaagtgtaattgctctccaagtcccgtcccccagttccagggcataattacaagttttcattctgtttatttagcgcgtggaaaagacacatttccttagaaagatttatcatcatctttgacactccaataagacataaatatgttgggaacaggcccccccaaaatctcgccatcaactggccccaaaactggccataaacaaaatctttgcaccactgtgacatgttcgtgatgggccgtgacgcccacgctgggaaggttgtgggtttaccagaatgagggcaagggaacacctggcccacccgggcggaaaaccgcttaaaggcgttcttaaaccacaaacgatagc

SEQ ID NO: 82864 - DNA, 381 bp, Homo sapiens
gtttgatttgcttttttttttagagttttacatcagtgtttttcaggaatattggtctttcattttcttttcttggaatattttctagttttactttgtcagagtaaattctggcttcacagaattatttgtagtctctcctgtcttagtttattcatgctgctataacaaaataccacagacaaggtggtaataaataacacaaatttatttttcccagttctggaggctaggagttcaagaagctggcaagttcaatgtctggtgagaacccattcttcataggtggcaccatctaggtgtccttacatgacaagagatggaaggacaaaaagatgtgaactattgtgaagcccttttttaagggccttaaatccattc

SEQ ID NO: 82865 - DNA, 333 bp, Homo sapiens
ctggtgacttctttcaaatggtgactgatgtgataaggtgtacaatagtaatgctggtaaatattttcatagacaaggaattactgaagtgaccattacaatcaaaatcattttaattacgtgagacttcaactaatttaaaatcctgtttccacaggagcctccttgagcttctaaaactgtctccaccttgattacctggagatagtctgggaaattttcttctatctttcagtgagcaactaggggaattcaggtagacaggcagctgggtagatgataggtaggagctgggcccctaagaaggctattctgctctccaacgaagcctgg

SEQ ID NO: 82866 - DNA, 2888 bp, Homo sapiens
  misc_feature (1782)..(1782): n is a, c, g, or t
agaaggaaaccagagatctggtgctattacgtcccagcgtctgagagaacgagtaagcacagaattcaaagcattctgcagcctgaattttgaaggagtgtgtttaggcactaagcaagctgatttatgataactgctttaaacttcaacaaccaaaggcataagaactaggagctgctgacatttcaatatgaagggcaactccacccttgccactactagcaaaaacattaccagcggtcttcacttcgggcttgtgaacatctctggcaacaatgagtctaccttgaactgttcacagaaaccatcagataagcatttagatgcaattcctattctttactacattatatttgtaattggatttctggtcaatattgtcgtggttacactgttttgttgtcaaaagggtcctaaaaaggtttctagcatatacatcttcaacctcgctgtggctgatttactccttttggctactcttcctctatgggcaacctattattcttatagatatgactggctctttggacctgtgatgtgcaaagtttttggttcttttcttaccctgaacatgtttgcaagcattttttttatcacctgcatgagtgttgataggtaccaatctgtcatctacccctttctgtctcaaagaagaaatccctggcaagcatcttatatagttccccttgtttggtgtatggcctgtttgtcctcattgccaacattttattttcgagacgtcagaaccattgaatacttaggagtgaatgcttgcattatggctttcccacctgagaaatatgcccaatggtcagctgggattgccttaatgaaaaatatccttggttttattatccctttaatattcatagcaacatgctattttggaattagaaaacacttactgaagacgaatagctatgggaagaacaggataacccgtgaccaagtcctgaagatggcagctgctgttgttctggccttcatcatttgctggcttcccttccatgttctgaccttcctggatgctctggcctggatgggtgtcattaatagctgcgaagttatagcagtcattgacctggcacttccttttgccatcctcttgggattcaccaacagctgcgttaatccgtttctgtattgttttgttggaaaccggttccaacagaagctccgcagtgtgtttagggttccaattacttggctccaagggaaaagagagagtatgtcttgccggaaaagcagttctcttagagaaatggagacctttgtgtcttaaacggagagcaaaatgcatgtaatcaacatggctacttgctttgaggctcaccagaattatttttaagtggttttaataaaataataaaatttcccctaatcttttctgaatcttctgaaaccaaatgtaactatgttttatcgtccagtgactttcaggaattgcccattgtttttctgatatgtttgtacaagattgtcattagtgagacatatttacaacctagaagtaactggtgatatatctcaaattgtaattaataatagattgtgaataatgatttggggattcagatttctctttgaaacatgcttgtgtttcttagtggggttttatatccatttttatcaggatttcctcttgaaccagaaccagtctttcaactcattgcatcatttacaagacaacattgtaagagagatgagcacttctaagttgagtatattataatagattagtactggattattcaggctttaggcatatgcttctttaaaaangctataaattatattcctcttgcatttcacttgagtggaggtttatagttaatctataactacatattgaatagggctaggaatatagattaaatcatactcctatgctttagcttatttttacagttatagaaagcaagatgtactataacatagaattgcaatctataatatttgtgtgttcactaaactctgaataagcactttttaaaaaactttctactcattttaatgattgtttaaaggtttctattttctctgatacttttttgaaatcagtaaacactgtgtattgttgtaaaatgtaaaggtcacttttcacatccttgactttttagatgtgctgctttgatatataggacattgatttgatttttattattaatgctttggttctgggttgtttcctaaaatatctgggtggcttaaaaaaaactctttaacttgtaataaacccttaactggcataggaaatggtatccagaatggaattttgctacatggggtctgggtgggggcaaagagacccagtcaattacatgtttggtaccaagaaaggaacctgtcagggcagtacaatgtgactttgaaaatatataccgtgggggtagttttaccctatatctataaacactgtttgttccagaatctgtatgattctatggagctattttaaaccaattgcaggtctagatacctccttctcagcactattaaagctcctaagttagaggagtgcctaaaactgagttacctaaagtttacttacattaaagtatgaatattaattttagaaatttgagactttattctgtaccagccctgtataataacaggttatctaggaccttcctctgaggtaggtctaaatactgatctctgaggcggaactaacgttttggggactcagcatctctgccaggttccaggattatagacagaagagtcctgtcataccactttctggaaaagtcctaatttcatgtaatccttttattttcaataaaaacaaatagctaaatgtataaccaactatgatgttatgttttcaataattttgtaaaacagctcatataaataaaatttttaattggaagaaaaaacgt

SEQ ID NO: 82867 - DNA, 213 bp, Homo sapiens
ttttcctcaccaaagtacaatgctcagaagaaattagaaaaaggtctattttacacaataaggttaatagggtattttgctttataattttaagacatttttaatttcgtttaaaaagcacactacaggccagtggtggtggctcatgcctgtaatcccagcactttggtagggactgagcccaggagttggagaccagcgtgcgcaacatag

SEQ ID NO: 82868 - DNA, 746 bp, Homo sapiens
gcaatgcagaaatcccatgtccccaaggacacgcgctgccgttcagaagtagcaggagagggggtggaataaatcatttcctctgatcttgttagtgttgagaatattttagggggtagcaaatgcattgcaggtctaataccagaaggctactgcaggcagaaggaaaaaaaataacaaaatttctctgtttttcctttaaatatgatttcctctttatatatttttaaaattgttttatgaggggtttttcccccctttctgattctgcaggttcttccttctacattatcatgttttctgtcatccagggattcttcctgatactgcccctggcagctgtaatatacttaatgtcaattgttactccagtaatatgttcggttcatttagtgtaaatggtcctatcattctgggaggtttccctgagccaagtgagaaatggctttcatgaatatccaggcttgcatggctagaggaatctgccacgtgcgagcctggtaattattttttctttctagaaaatatactgtatttaatttttaaaatgccagcgatttggggttttttaagacaatgggcagttgtggaaagaatagagcagttgaaatttcttcaagttgggagcagaggcacagaatgtattcatcttgaggagttaaactttgatgtgaggagatatacatagttgcaaactgtgttttttcccttgtcccctaagaaataaaattaaaaggtgatatgta

SEQ ID NO: 82869 - DNA, 500 bp, Homo sapiens
tgggaatagggaccaaactccctctttcaagcctttttgtagtgacattaattcatttatgaggatgccaccatcatgacataatcatttcccaaaggatttcacctcctcccactgttgcattggggattaattttccaacacatgaattttgagggacacattcaaaccatagcaactggtatatagtaactaggtggcccgatggtcttcataataaagttatattttactttagtataaaataaaaggtcaaggcttgtaactgtgatgagactgcttcatgtatatctcccctagtgactatcacagttgactgacagctccaggggttcatctttgtatccatcactacctatagtccaaaatccccatctcacagctgttgtcagccaatgacaaagcatagtgaggtgctgttcctgctcaatatggaggaaaactttggcttgataactctccattggcctgccaaaatatgttaagtattgtgctactat

SEQ ID NO: 82870 - DNA, 772 bp, Homo sapiens
aaatgtaaaaattagcggggcacagtggcatgcgcctgtagtcccagctacttgggagactgaggtggggggaatacttgagcccgggaggtcaaggttgcagtgagtcatgatggtgccactgcactccagcctgggtgacagagagagaccctgtctcaagaaaaagaaagaaaagaaaagaaaagaaaaaaacaggattgtaacaaatccattcacttcctgtccctctctctttacagcttcagcagcacagcctccatctttggacccaagcttggaaagcatagctccctcttttagacgttgtccatttcaaagcatctccagtctggatcaacagaaggatgatgtgtttatgtccttccctgtctgttccttaaagcaaccttaagtctggaacatgaattctcttttttaaacaaatttaaaaactttgtagagaattcaaaaggtacaaagggtagccacacaggctaccattgtcaccgcttccttgtagcttctggactcttggtggcatttgccaattcaaacaaagaaaaagtctatgtgaatagttttgttttcccctgtgactttaagctacttaaaagaaaatttggccagacaccgtggctcactcctgtaatcccagcactttgggaagctgtggcaggcagatcacgaggtcaggagtttgagaccagcctgaccaacatagagaaacctcgtctctactaaaaatacaaaacaattagccgggcgtggtggcacatgcctgtgatcccag

SEQ ID NO: 82871 - DNA, 503 bp, Homo sapiens
acagcgtatctcacataacattacagaggtctcaaaatctggagccagtgtaccttaaatggcaattatattgggttttcagttcttgtatttctcttctttctttctttttttttgagacggagttttgctttatgttgtcccaggctgtgggtgcaacatggtgcgagtctcagactcacctgcaaacctcagacctcccaaagtatctgaggattacagagcatcctgccaccacacccgtgctaaattttttactgtttagtggtagaagacggatgtttacaccaatgttgggccacggctggatctcaacacatcctgaccttcaagttgtattgcgcccacctcgtgcctctcaacagtgctgcaggttacagagtgtgagccacatgtgcccgcgccggatagttcaagcaattctcttgcctcagcctcctgagtagctgggattacaggtgcccaccaccacacccagctaatttttgtatttttagtagaga

SEQ ID NO: 82872 - DNA, 237 bp, Homo sapiens
cctgaaacaaattataacaactttattaactccagttcactcatctattaaaagatcataataatagcactctatctcacatggcaatgttaaggatttaatgagataatataagtaacatgccttgtgcagggcctgacacacaataagtacagggcatgtttttaataggtcactgtccaaacacatatcctgatcttgagggtcttctgctcttctcttttatgcttcttcatc

SEQ ID NO: 82873 - DNA, 435 bp, Homo sapiens
attcgcggccgcgtcgactttttttttatgcaaatcattgagtgttttattgaacaattaagaaatgtataaccatttcattactttacaatagtaaaactgatttgtaactttttctgtgaatatgcgaatttgtatttgaaagagtttagacttgtattgaatgagatgtatcttgactataaagtgttttctttttcagtacaaaatatacaaaccagtacatgttttaaacataaatataactgagaataggttatgcttctactcaaatgcacttgtggaaagtaccattcatccgcaaagacacttttaataagctttgacaggaagacaaactcgacagtgttgtcagattttctatttaaaattacatttatattaaccccaacctttcattttagcaaaatggtttatggtttcttctactttata

SEQ ID NO: 82874 - DNA, 179 bp, Homo sapiens
  misc_feature (1)..(1): n is a, c, g, or t
nccccctggaaatcatagtatcagcaggagaactagccagagacagcaagaggggactcagtgactcccgcggggacaggaggattttgtgggggctcgtgtcactgtgaggatattgtagtagtaccagctgctatagtgggaggggagaactactactacggtatggacgtctgggg

SEQ ID NO: 82875 - DNA, 165 bp, Homo sapiens
  misc_feature (1)..(1): n is a, c, g, or t
nccccctggaaatcatagtatcagcaggagaactagccagagacagcaagaggggactcagtgactcccgcggggacaggaggattttgtgggggctcgtgtcactgtgaggatattgtagtagtaccagctgctatcttgctactactactacggtatggacgt

SEQ ID NO: 82876 - DNA, 700 bp, Homo sapiens
ccgtgcccagccaatagaaatgtaaatttctgctagtgaaagatgtagtgaatgagaaatttggggtggagcctatcaatctgtggtttagcacgccacccagttgattctgatgaccgctgaagcctgagaatcactatagataaccatttcatcccacctctgctggagtctttcaaagcaaatgctgtcattttatttgtaaatacattagtacataaactgtcttttttaaaacataacacaaattggcgtaacatttagagagcagcctgctaatgggtccccatatttaaataggcttaccctctgatctcttaattccactcatactatctactttaaagaaataactggacagatgcttcatgatgtctatacaagggtgcttaaatgcctagatggggaaaacttagaaataccatgtctcatagtgagggattggctaaataagttatgttttatccagtcaatggaatgctatgaaatcattatacagaaggatgtccctgatgctgttgttacgtaggaaaagcagttttcaaaccacatattgggtggtcccattttcttttctctattcaggatgtgtgtatgtgtgtgcgcaccatgtgcatgagaggggatgtgtttttgttgtgtataataacttaagcacataggacaaaaggctgaaatgttacacaccaaaacacgaata

SEQ ID NO: 82877 - DNA, 452 bp, Homo sapiens
cactgggaccccagcctggcaacggctagtgcgtcgtcggtgctcagttagccccaacatctctttcctttcctccaacaggaaacacaccttccacctctaaaccttagctccaccaagctccaaggggagagaagagagggcatatgggaatgttttgctggaccccatactgcactcccaggccaggaagctctgcatcaggaagccagcaccattttcacctcctctggggtaggactgaggggaccatggccaagaggaaacagatgcccccttagctcctccctgggtagcctgagcgggccagggcctgagagcatgccagttttagcctgtcttcctgtccttcccagccagacccctctcatcctcctcccccagtggttttctcattacctgtcactgacggagagcccctcagaggtcaaggccaaagtgaggtgggctct

SEQ ID NO: 82878 - DNA, 2461 bp, Homo sapiens
tgttgcatacagatgagttggcagccggtctgagctggcccacagactcataaaatcaacagggcctcgggtaccctcacccagcatatccaaactcttgcatcaaaggtgcagggacttgctcacatcgagaatctggttgctttcttggagaccaagaaaatgagtttttgtttctacatttactccagcaatccatgagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtgaaaaaaaaaaagat

SEQ ID NO: 82879 - DNA, 2346 bp, Homo sapiens
gtctgcatagaaagaccaacaaccagcaccacttccttgctttttccagccatgaatgcttccagtcggaatgtgtttgacacgttgatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtgaaaaaaaaaaagat

SEQ ID NO: 82880 - DNA, 2631 bp, Homo sapiens
tgttgcatacagatgagttggcagccggtctgagctggcccacagactcataaaatcaacagggcctcgggtaccctcacccagcatatccaaactcttgcatcaaaggtgcagggacttgctcacatcgagaatctggttgctttcttggagaccaagaaaatgagtttttgtttctacatttactccagcaatccatgaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtgaaaaaaaaaaagat

SEQ ID NO: 82881 - DNA, 2594 bp, Homo sapiens
tgttgcatacagatgagttggcagccggtctgagctggcccacagactcataaaatcaacagggcctcgggtaccctcacccagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatctctgctctgaacagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtgaaaaaaaaaaagat

SEQ ID NO: 82882 - DNA, 2764 bp, Homo sapiens
tgttgcatacagatgagttggcagccggtctgagctggcccacagactcataaaatcaacagggcctcgggtaccctcacccagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatctctgctctgaacaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtgaaaaaaaaaaagat

SEQ ID NO: 82883 - DNA, 656 bp, Homo sapiens
tccactttcttgaggttgtctatatttcttggctggtggcttcctttcttgctcaccaaaccagcaacatttcagctctctgacccctcttccctggtcacgtctcctctgactctcttttacctccaaggaccttagaactacacacagctgcatgattcaggatactcctttattttgaggtcagccaattagcgaccttaattccatctacacaggtaatttccctttgccatgtaacctaacatattcacagattctgaggactgggatatggatatctttggggggacctttgtcatgtctaccactgaagattcaaaggtctcctgatgagaagccttcctcctgtgtggggtgagatagaaagacatttttatggcgctaaagaaagagaagatgtttctcagttatttttttcaattatttatgttggtcgcaacataaaagccaaatggcctttccttttctgaaatctatgccaaattgtaaactccacattggatttaagatgcagctaaatcctaacacagaaaacagaaagacaaccacttcccactagcatttatggagaattctgcagttcaagtgcacctgcacaaacatttaactctcacaatagcccctggtggcagatcctttcctcatttgacaaa

SEQ ID NO: 82884 - DNA, 367 bp, Homo sapiens
ttctttaggcactgtcttatccatttctatgatttcaaagaaaacctgaggctgccattactgacctaaaccttcctctctggcttcaaagaaggatttccaaccaactctcaggcgtaccgcatgcaactagaactcagtatacccaaaactggaaactcaatgtctcccctttgtatcaaatctgtccatgcacctgaaatcctgaatccactggctaggatggaatagtcaatatgactatcctactgttcagcttcatctcctatctcttcacccacaattgcagctcatttcaatgtctccccctttccagaacaccccaggactttctagatctgcatgctttgcatattctgtgccctct

SEQ ID NO: 82885 - DNA, 704 bp, Homo sapiens
ctatgaaatgacttcttaaatatttagttgatagactgctacaggtaatagggacttagcaagctcttttatatgctaaaggagcatctatcagattaagttagaacatttgctgtctgccacatattgagatggcactaggtgcaatagcagggatagattttgttggtgagaggtctcatgccttgagatctgtggtggtctttaaaatggtggccagccagaccaaggatgtagtatctcatagtccccaactaaatgctggctttccactttaggtgatatttttctaattagaaaactattataactcacttattgtttgacaattatagattgaaatttcctaattctaaattttaagtggctcttcggtttcagtgctctatgttgtttgttgttggttttggatggcattacatattatatgttctagaaacatgtaatcctaaatttaccctcttgaatatgatccctggatgatatttttatcataaatgcagaataatcaaatacattttaagcaagtaagtgtcctccatcagttccgtattccagacttgggaggatgtacagttgctgttgtgtgatcaaacatgtctctgtgtagttccagcaaatcaagctgagcttcaaaaaagtttgagtctcagttttgtgaaagtgatttattcttaaaaaaaaaaaaaaaagaaagaaagaaa

SEQ ID NO: 82886 - DNA, 1692 bp, Homo sapiens
taggaacaattttaattagatatatgcaaattacccttaatttatatctcaataggctcctcaggaaaactgaggttcaaatcaacgggcctaaagaagaagtttagcagctgaaaatacctttgagaattttctcctgtaaatctacagctggttccaaattaaagtttgtcccaaggagagcaagagcagagtaactagcctttgttttcaaagattcccctagttgtgaacatgcataaagcactttgaactacaggaaaatcttatctcaaatttgaactattattttattttcagtgatctctctgtacactcctctcgggcccggatagcacattaggtatagaagtcaggagtttctacaatttctctagaagtgtttggcagcatgaagagaaatctttaatcacaaagaagtatagttaacttactaattctttgaattgtaataatgagagataggcaagaacaacaaggggtgagtagtgctaactttctccggtaaccttgacaactggctttaggaatccagacctgtatcaaatttggtcccatcacattgtcctgttccctctctttgtttttctctgttcacttaattgaaattgcaattattttaaagattgagccaagaatgtcaattatagcacaaaagaaaggttacaaaaacgttgtcaggctatctgttaatcgagttgagttgaaaacagtatgctttcaaatgaagtactacaatttccttttttaaaaaaatagtttctaatttgttttttccttcttttgtggtggaggggtatagatgggtgaagtactggcaatgcagtgccaatctccctctgttactgttccctctagtgcctggggttggggcaggtgcaggggtgtggggaaggagagagaagcaatggggaaacaggtgtttctctacttaagacttcatgaacacatacagtcttgaaatggctagaaaagcaacaactacaatgataaaaatcaacagatcaattgattttggcatttcggcagcaccccttccttttctttcctgggtatcttgcagtagatattaattagaaatacccaaagaatttaattaaactaatttattcccagccttattccaaaaaggatttgaggaggcaataaggatttgtagtacaaaatgcatggtcttcatctgcaatcaataaaaaaatctattctttggccccagacctgttagtttaggtaaatacggtttctttctcaaggaacaggtttttgttttaactgttctatcctcaaagtaaagagagaatttctctcttaaaagctcatgagtgctatttgaaatggaagataagattttttggaggaaaaattccttcatggtaggatggaaggcttttctttctaaggggaaaataatacagtaagggtgagcagttatttgactgtccatggacagtaacaaattaagaaataaaaatcctttactatcttgagaagaaagaaagggaaacaaataaatcaacaaaaaaaccttactaaaatacacattcctccagtttcagatttctaaaaagtaataattatgcttaaatcaaggtttatagatagcaaacaactgtttgaatgtgtgaaagtattatccctttgctctaccagtgtttcactttctttgaaggaattgcgtctatgcacacttat

SEQ ID NO: 82887 - DNA, 488 bp, Homo sapiens
gggcctgtaaaggtgttatcctcacaggagggaccatgaagtccatccccgctgggtggacggcagccctgggacccctcctcctcccctcccaacctgaccctggccagtctctgggcccaggcagtgcttgggaacagcgaggatgatcgtggcgggcacttacaagcacatcctcatgccacgcactggttccttagacagccaccaggcacctgccacgtgccccactctgggccacgcagggcggcgcgtgggcacaaggaaggcctcgctgctcccctgctggaagttactggaaagcgcagtgctcctcctctgcgtcttctcagatgacctacagcactttctggcttggccgcatgatgcagggaagggctcagagcccaaaacacaggccccaagagcccacgggggtgggcgggtcacactcacttgagcgtccccacttgttgaggaccaggacaggcaggaccactggcggcagg

SEQ ID NO: 82888 - DNA, 726 bp, Homo sapiens
cgatgatgagtggtggggatagggtgggattctagacccccactgccaagtcctgtgctcaaccactagccataaacattgctatggactgagcactcacaacgtgccacacacggcattggggaatgtatgtgccgtgcctcgccattgccccactggagccagtactattaaccccattttacagataggcaaatagggcacagagaagttatgcaacttgcccaagatcacacagccagtgaggggcaaagctgggattagaacccagggagaccaactcttatgcattgtgctataaatgaataaatgaaggaacctcagctgcaaaatctccaagaggaacagtgactctgtagagtgcctcaccactccccgacaccctctcagtaggacggggcaggaagacaggaggaactgaagccccctgaggtgcagaccccaaggggctgctgctgtgaaggccaaaggtggaagggagaaggggccgggaaacaagagtcttggagtgtgctgctgctcagtggctccagagccgagggggtcttggtgcagcttgatgtggcatctgggcccagtgccctcaagtgccaccatctcaggctgcgctgcagcatccgctgctgcaggccctggaagaaggagctagagaaggggcagggtctggctctgtgacccaggctggagtgcagtgggacaatcttagctcactgcaacctctgcctc

SEQ ID NO: 82889 - DNA, 396 bp, Homo sapiens
ctctaactgtttttagttgcatatggaaatatctaaaaaaatatttagcatttttactaagtgcgttgaggcctctccagtgtcctcctggctgtggctgctttgtcattctctttgactagccagccatctaccttgctcaggcctggaataaaagaagaacaagaagaagaaagaaatgaaatgaaaaacagaaagaaaaaggagaagaaacatttgtaaaagggtcatcttcccatctgcctcccctccttttcctttcatttttggtggcggcacaggaaagccccacttccagtctgatgaggaaagcgacaatctatcaggtacagaaccaggggctgtctgcgaagatggaggggaattatgcttcggattcctctgaaatattggcca

SEQ ID NO: 82890 - DNA, 420 bp, Homo sapiens
ggaagtgacttagtaagcgtttggaacctcttatttctagatgttatggaagcaatgtgaaatgtgacagggtcgccaacatgggtgagttgttcccaaggcaggaggcccaagggggtggtattaaaaatgtcttctaaagccctctttctggcgcctctgtccctgcaaagccagtacaccatctggcatttaggcactgtgccattttaacagatgggactgagtattgaaggctctcagactatgtactaccatcaactgtggtgttggaacagacatttcagtagaaatacccaaccaattctttttcacctcatcttttaattctgcagtaaaagaagatgatatttcttccttagagtgaggaaaagacaagaaagacctttctcttggtgtctggcgctatcagaatatgag

SEQ ID NO: 82891 - DNA, 730 bp, Homo sapiens
atccacttgttttgtttgtttgtttgttttttggtttttgcttgtttgctgatgggcagtggggaggtgcgagggtggagggccttctttgtgcatatatagcgatagtctgcactaggccaagcccgctactcctgggagaatgggaacacgcaaataatctaaacaaagttttctgctgtcatcttgtgaaggaccctctcccccaagacatctatgactggggtctatgggttaaggaggtgaaaaagtggccccatcccatatccataactgaatcacagaatccgtggggatttgaactgagtggctggcgcaagacctccgtttgcttccagtagctgctgggagcgagggaagaggatatcggtaactttgggggcgccaatgtggcttctgtgtctgccccttgaaagtttatacccggcgcttaacaaatcctttacaggagcacgtacgtccctgacctttcaggatactgttttatattaaaacatggacaggagggtagaaaagtaaaattcgcctgcaaaatggcttgtcatccttgggccggcagatctccaaaaccattttcttctaaagcaacaaaagagaaaaaaatacgttctaaaaggaaattacgaaaagagcctaactttcctaaaccaacatcacttcactcccctatcctaaactccacccaggtccggggtgcaaccgcaacactcccgtaggttcgagttctccc

SEQ ID NO: 82892 - DNA, 283 bp, Homo sapiens
gatcctcaggactgcgtcctgctgggcctgtgggagaagtgactgggggggacagttaaggcggcaagacctcatcactgtccaggcacctgcccagccaccaaatctgtggaccagggagcaaacacaggcaagggtactatgcctggctgcagtcagagagagtctcgggaggagcaggtctttgtgctctagggcaggacacagtgctctaggtgggaactggtgccccaggtgggaccgaattccccaggtgagacttagagagacccggtgctccagg

SEQ ID NO: 82893 - DNA, 933 bp, Homo sapiens
ggaggcagctgggctgcagctcagaaagcaacgctcatctgcaagttgggacagcagaggcccttcattcctccccagggctcccacaccttgggagggactgtgaagagtgactcttgtccagtggttttcaaactgggttcctctaagccctggggtattagtgccccagggacccctgaagtttgttactgctgctctgaagcttttcagcatttcttgaaataatgaattccagtaacactgatagctcttggccggcccaccatgaagcccttgatcccagcctggctgagaatagactgtttcacacatcactaactctgccccagcctctggctcagagctagtagcaggacatgaaggtttactgaacaccaaacagatggtgagtgccctgctaagaacttcacatacatctgccccctccatcctcctcactgtgaggaagtgtcatcgtccccaccagaaaaacaaggactgggaggtgtcctgacttgcccaggcagagactgggtcttgctctgtcacccaggctgggtgcaatggcgtgatctcggctcactgcaacctccacctcctgggctcaagtgattctcatgcctcagcctcccaagtagctgcggttatagatgtgcacctacacgcccggctaattttgtatttttcacagagacggtgtttcaccaggttgcccaggctggtctcgaactcccggcctcagtgatctgcccaccttggctcccaaagtgctgggattacggcgtgagcccactgtgatccaggtctaatttacacacattttaaccacgcgtgtaaagggacgggagaagagacgagaaaagcacgtgtgcatgaatcactgctacgagtccactccaattccctttggtgagcactcaccctttaaaggaatgtgacctgccgttcccc

SEQ ID NO: 82894 - DNA, 380 bp, Homo sapiens
agatgggactgcggcccaagactctgtggggcatgtagtgatttggaagccaagaaattggttttttaaagagtaactcaccaatcttccgcagcttctacatggttattttttttcttttggtgacgcaaagatagtcctaattcctgtagagccttggaacctcaaacactaagaaggtctccaattttgtggggctgctccacctccagatggttctggcccccataggactaggcagactgtagtgacatctgtctgaattccctgtcctcgtgttcctggccctcacatctgctgggcttggtaatgccgtctccaaagagcctgggggctgtgacagaccttcaggaaagtcagtgtgctggaagaatttgatt

SEQ ID NO: 82895 - DNA, 486 bp, Homo sapiens
gagacagggactcactatattgcccaggctgaactcaaacccttgggcacaagtgatccttccacctcagcctttccctcatttcttataggtctgtgtactaatccaaaagcatgttaaggaaataaaatcagttttgttgttaattcagatgattttagagtatatcagtcctagaatgactaattccccttagaatgtctataggtatcaagaatagacctttccataaattggcccctgaatttcactggaacttaaaaactcaagaatgaagggcatcctggagccagtctactgacaagctatgattcaacacacttcaaagctcattttggattttacctattttgaaccagtctccagatgttgagacagaatcaagattcacagcattggccaggcatggtggctcatgcctgtaatccgagcactttgggaggcggaagcgggaggatcacttgaggtcaggagcttgagaccagc

SEQ ID NO: 82896 - DNA, 868 bp, Homo sapiens
aattgattgttctacatcaaaataaatgttctctaactttcatgtgggcaggaaccatatggagaccatcttaaaaacacagatccccagagattgtaacacagtaggtctggggttgggcccagaaacctgaatttttattatttttttgagacagggtctctgtcgcccaggctggagtgcagtggtacaatctcagctcactgcaacctctgcctcccgggttcagtagattctcctggcctcagcctcccgagtagctgggactacaggtgtgcaccaccacacccggcaaaagtttgtactttttggtagatactggctttcactgtgttggccaggctggttttgaactcctggcctcaagtgatctgcccgccttggcctcccagagagctgggattacaggcgtgaaccaccacacctggccagaaacatgaatttttaacaagcatcatagtgaattcttctgtcattggttctatgttttgaataactgctagagaacggccagctgaggtcctagtaagtgagaaacaaatcagtcaaccaaccaatcagcaccacccccttccggaaaagtcccaagcatttgacaaagatttgtcacctacaactatctgccactgtgtgaagagggctactttaaatgaacccaagtcttggtaagttttcttgagaaaaacagaaacaggtacaaaatgaaaacaactggggattaagtaacagtcatgaaggcagtgatcatttaaataggactggaatgggtgggcttggagccaggttgcacaggtttgcaaaagccaattgttaaattttcagaaattttgtgagctggaggctaaacaaaaccattgttaaaaattaa

SEQ ID NO: 82897 - DNA, 393 bp, Homo sapiens
aattgattgttctacatcaaaataaatgttctctaactttcatgtgggcaggaaccatatggagaccatcttaaaaacacagatccccagagattgtaacacagtaggtctggggttgggcccagaaacctgaatttttattatttttttgagacagggtctctgtcgcccaggctggagtgcagtggtacaatctcagctcactgcaacctctgcctcccgggttcagtagattctcctggcctcagcctcccgagtagctgggactacaggtgtgcaccaccacacccggcaaaagtttgtactttttggtagatactggtaacacggtgaaaccccatctctactaaaaatacaaaaaattagccgggcgaggtggcaggcacctgtagt

SEQ ID NO: 82898 - DNA, 612 bp, Homo sapiens
tctgtttgcattaagttccattgccagggttcagacctgccattggggacccagtcctgttttgttctcaacaaacatttattgggtagttaaccatgtgccatgttaacctgtgttaaatgctaggaatggaaaaatgagtatgttccttctcaggagagctcttagacaacaagcaaagaatgtcaatgaaatttttaagtgctcagtgttccaggccagagtacagagggagggacactttgctgtctttcagtcctttctttttaattgtattgattcttttcctcggtaataaataagtccatcctagttttattaagaaaaagacaggtacaagccaaattgtattcatttaatcatattcgatttcaaacaaataggttctgtgtatgtgtttgcaaatcaggtgcagcctttcgggttgcttgacaagttgcttgggcagcccttagactataaagtttctacgtcattgatttaagggtgttttaaaatgcgataggctagcttccagaccatgattagtgtcactcctgagaagtagaggtttaatatttcataactgatttcattgcagatttatgtcttccatattctctttaaaaaaaa

SEQ ID NO: 82899 - DNA, 614 bp, Homo sapiens
agattgtttccaccttttggttattataagtatatccagctatgaacattcatgtacatgcctctgtgtggatgtttatttttgtaattcttgaacagatttctaagagaggatttgctgtgtcatgtggcaagtttctgtttaactttttttaaaattgtcaaactgttcttgatcgtggctgttttattttacgttccctccaataatgtacagtagtcctttcttatccacagtttcacttacctgaggtcaattgaggtctgaaaatattaaatggaaaattccagaaataaacagtccataagtttttaattgtgtgccgttctgagtagcatgatgaaatcccacactctcctgcttcgtcctgtccagaacgtgaatcatccctctgtccagcagatccacactgtatgcactgcccacctggtagtcacttaggagccatccaggttatcagattgaccatcccagtatcacagtgcttgtgttcaagtaatccttatttcacttaacaatggcaaagtagtaattctggcaattcatatatgccaaagagaaaccataaagtgcttcctttaagtgaaaaggtgacagttctcaacttaataaga

SEQ ID NO: 82900 - DNA, 434 bp, Homo sapiens
ccatgttagccaggatggtctccatctcctgaccttgtgatctgctcacctcggccttcccaaagtgctgggattataggcatgagccaccgcgcccggcctcttcctcagtgtttaaaaaagagtttgagaagaattgctgataattcttctttaaacatttgatagactttatcaatgaaaccatctggttcctggcttttctttgttagaagttttaaaattagtgtttcaatctctttacttgttttagatctatgcagatttttaaatttcttcttgagtcgattttggtagtttccatgtttctaagaatttgttcatttctctagagtttctaattcattgtcgtgcaactgttcaaagcattatcttataatcctttgtatgtctgtaagtttggtaataacacttccacattcattttttatgaa

SEQ ID NO: 82901 - DNA, 418 bp, Homo sapiens
ctggatcctgttattttgatcactactcttggtagctaggccatgatcagcctcaagaagttttctgaacatggcatttcagacagccattatccgtaagttggagttactgttctagatgaaatctttgtcaatcctatccagtaaacatattctgtgctttttagatttatggctgcttaccactgcttctttagttgtgtttggggtactgttatctttttctgctgccaagttacttgtgaggagcctaagaaaccacccgtgtcacaacacttcagattgctctggatttgcttccttatctgacagtttcattatatttatttatttatttaaacagaatctcactctgtcacccagccgagattgcgccactgcactccagcctgggcgacagagggagatgccgtttctt

SEQ ID NO: 82902 - DNA, 476 bp, Homo sapiens
cagacacaatattggtgtgtatattcagggctcaataggatttataaccataggattgatagccagcttaacctgtttcttccctctaaattttctggcacaacctctcggtaaaaattgttcaaaaatagattttatgttacagaaatcattcttccatcatctttcctaaaagagttattctggccaggtgtggtggctcatgcctgtaatcccagcactttgggaggccgaggcgggtggatcacaaggtcaggagatcgagaccatcctggctaacatggtgaaaccctgtctctactaaaaaatacaaaaaattagccaggtgtggtggcaggcgcctgtagtcccagctgcttgggaggctgaggcaggagaagggcgtgaactcgggaggcggagcttgcagtgagccgagattgcgccactgcactccagcctgggcgacagagtgagactccatctcaaaaaaaaaa

SEQ ID NO: 82903 - DNA, 128 bp, Homo sapiens
tgggaggttgaagctgctgtgggctgagacagagatcacatcattgcactccagcctgggtgacagaatgagaaaccctgtctcaaaaaaaaaaaaaaagtacagttttggtttttgctgtgactggg

SEQ ID NO: 82904 - DNA, 400 bp, Homo sapiens
cagtaagccatgattgtgcctctcacttaaacctgcacgacagagtgagactctcctcggggctgggcgggggaagtgggtcaggacatagaggtcaagaagcatgttcctttcgcctgctcagagtctgggaagtatagtatgattaaggacatgagatttgccattcagattgagctgtagctctgctacttggtagaggtatttgtcattggcaagttactttcagaggtttcatttacttagctgtaaaattgtttaaagaatcttatgtagagttttgtaattattgaagtcattgaatgcatgtaaagtgcctagctcaatgtctttcttatagttattgaataaaaatattaagtgttattgttaatgaagatactggtaaaatatcccatgt

SEQ ID NO: 82905 - DNA, 4622 bp, Homo sapiens
  misc_feature (2316)..(2316): n is a, c, g, or t
gaattccgggccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcngcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacgtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcgcagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaa

SEQ ID NO: 82906 - DNA, 3645 bp, Homo sapiens
  misc_feature (1646)..(1646): n is a, c, g, or t
ggcgcggcacgaggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcngcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcgcagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaa

SEQ ID NO: 82907 - DNA, 916 bp, Homo sapiens
ctggtatggcgcacacaccctacacatgcctaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagc

SEQ ID NO: 82908 - DNA, 4315 bp, Homo sapiens
  misc_feature (2316)..(2316): n is a, c, g, or t
gaattccgggccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcngcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcgcagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaa

SEQ ID NO: 82909 - DNA, 3397 bp, Homo sapiens
  misc_feature (2316)..(2316): n is a, c, g, or t
gaattccgggccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcngcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagc

SEQ ID NO: 82910 - DNA, 3449 bp, Homo sapiens
  misc_feature (2316)..(2316): n is a, c, g, or t
gaattccgggccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcngcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaa

SEQ ID NO: 82911 - DNA, 4587 bp, Homo sapiens
  misc_feature (2588)..(2588): n is a, c, g, or t
ggcgcggcacgaggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcngcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcgcagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaa

SEQ ID NO: 82912 - DNA, 3415 bp, Homo sapiens
  misc_feature (1416)..(1416): n is a, c, g, or t
ggaacggcaccacactctgtgtttacctctcaagacgctgatgagcaactcatcccacagaacagctggtcctgaacatgtgtgtgccctgccgtgaggcgcacaccttcccagaggcgtgagtggggcccggccactagtgtcctggcggaagcaccggggctgctccatttgtctggagtcctgtcccagtggtgtgggttttgagtctcacccacacggcgccggccgagaagccatgagcggctctgcagggtggtgcggactatagacacctccatgcatggttgccctaggcagtgtctgccgccagcgtctgcctctggacactagctgctcagccaccaggacggcgttgagcgctcccctgcctctgcaggaggagaggggcagggagccatcaggaagggtgctggggcctggggcccgtcgtgctgtgtgtgtgcaaacgcagtgtggcgtcccctgatcaggagtgggagctgcgcgctgcccggttccaggttaatggaacacaggaagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcngcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcgcagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaa

SEQ ID NO: 82913 - DNA, 2046 bp, Homo sapiens
actggtgctgacaccacagaagtgctggtgtggacctgtgggtcgcttggttcgtggagagacagccacagcatcttcccagcatcgcggccggcacctggcacctgcactttggccgtcagagacgtgctggtaccgtgctacggacgagggcggtcactctggcgaccccagctctctgccgaggcagccaggcactggctcacgacactcatggaccagggcgggaccgaggaggaaattaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcgcagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaa

SEQ ID NO: 82914 - DNA, 3152 bp, Homo sapiens
ggcgcggcacgaggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgtagtcctgatgtggtctttaaggatggtgaatgagctttgtgctgggcggacgtccccgagacacttctccaggggtaacttcatctcctgggaccacgggcatccaggctggggcaccttctcctcaacctgcctgcccctcacccgccgtgggaatggctccttttcactcatac

SEQ ID NO: 82915 - DNA, 547 bp, Homo sapiens
agcggccgcacgctgtccctgcaggtggcctccaaccccatcgaatgctgtaagtggacgtccacgcgcccacaggggaggaaaccgtcccgtcacatgcgcttcactgtctcaccctctctcagcttttcgttcgtgtagacttgggactgaacggttcccaccaaacccaccacagtgtgtggccacgaggggtctgagttgatcatggctgagttattgcctgtggcctcccgggggcccctggcgctggctcctctgatggctgagcatggccagggaaagcggtgtgggccggggcttcccctcacgctgcgctgacctttgcgtatttgtgcgatgactgtgatttgagtgaaattggctgagtcttaggaagatattttgatgacttcttcagaacgaggtggagaccatcaggatgaagtgtgcacggcttctcccctagaagtagtggcatccgcaggggtcggcccgcaggtcgtggcggtgcttgctctgggtgggtcggctcacgtgtgacctgctgggtgccacacgtgtgccc

SEQ ID NO: 82916 - DNA, 525 bp, Homo sapiens
cccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgctttta

SEQ ID NO: 82917 - DNA, 4744 bp, Homo sapiens
  misc_feature (2745)..(2745): n is a, c, g, or t
ggcgcggcacgaggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcngcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcgcagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaa

SEQ ID NO: 82918 - DNA, 2977 bp, Homo sapiens
ggcgcggcacgaggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgta

SEQ ID NO: 82919 - DNA, 3103 bp, Homo sapiens
  misc_feature (1104)..(1104): n is a, c, g, or t
cctaaaactcagtgcccaggtccattgggataacaaggcattttctaatctgatttacaaagacaccagtatgacatggcagagaaataaaaagggggcagggcagggggacacaggcctcgaacccgccgcaggttttctctgcgttccggtgactcccggcggtctgtgctctgggtgctgagcaggtgttttctgttctctcgccagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcngcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcgcagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaa

SEQ ID NO: 82920 - DNA, 2683 bp, Homo sapiens
ggcgcggcacgaggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccaggtatgctcttcaccaggggccatctgcggcctgggcttcggcgctggtgggaaccggttcccagtcggtggagcaggacccacctgtgcacggtcaccgggacggggcttatggggtgtggcacggagcagaggctctgcgtggcccgtgtctgcatccggctgtgggtttttgtgtgagccgacagctgtgctgctgaagggaagaggtggatgtttatttctggggccgccggggccactgcactcacatcgctgctgatactcagggagcccacgggctggggacgcagaggagggcaagacgcatttgctg

SEQ ID NO: 82921 - DNA, 603 bp, Homo sapiens
cgtggagagacagccacagcatcttcccagcatcgcggccggcacctggcacctgcactttggccgtcagagacgtgctggtaccgtgctacggacgagggcggtcactctggcgaccccagctctctgccgaggcagccaggcactggctcacgacactcatggaccagggcgggaccgaggaggaaatgtgggttcctggggagatgccttgtcacaggcgtgagcgtcactgatggagaagcagggctgggggcgttgctttgatgtttatggtatttctctaatactttctcaatttttcttttcttacagttaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggagg

SEQ ID NO: 82922 - DNA, 962 bp, Homo sapiens
caccaacataaagtccgggtatcctaagcatgtggtgtgtatggtgtctgaaattgaatatgctgtgaaactgcctgtgtcgaaatgcagtgtttcccaagacctggaggctctctccagctgctgattgtgatcacctctcccgatcaccgctgagccctgcaggtcaccttctcctgacctattacaccactgattgcttatgctgggcacaattttatacccttgctgttgttcagtctaatcatccctataaccctatcggatcattcccatatgacagaggagaaaacctggggacacaggggctgtgtcctggccaaggccttgcttgcagcaaaaggcagagctggggtctagccaggagccccagcacagtcctgttcttcccccactaaactgagctgtgaaatagatcatggcggtctggaaaacgagctaattccgtgccgatggaggtgttgatggatgtccaccactctccacttgggaggaggccttaacatccccctcaggtctagcttctctctgtgactgagtaccttgggaaagtgggctcagaggaggaaagggacttacttgcccaagggccacagctgccaagtggcaggtaagggaccgttattctcctgtccctttcacagaggacaggaggaaagtgaggacaggtggggtacatgagtttagcctcttttctgcagcaggcccagatcagctttgcacacggttggtgctgacctcaaatgcagccctagaggggcctatctctgccctgagtattgaggtgcaggcttcttcccctttgttctgtccatttccaaaaatgtgaacacacacctcctacatgtttatattattgtgtgcatagatactaccattgtaacattttttgcggattaaaaatgcactattgtattgaaaatttcaaaggaaatgtgtaataaaacatttaaaattaaaaa

SEQ ID NO: 82923 - DNA, 498 bp, Homo sapiens
tcctgggccccatctcagcctgcagaggcctgaacgtttcccaggattgtcttctagcttctctctgtgactgagtaccttgggaaagtgggctcagaggaggaaagggacttacttgcccaagggccacagctgccaagtggcaggtaagggaccgttattctcctgtccctttcacagaggacaggaggaaagtgaggacaggtggggtacatgagtttagcctcttttctgcagcaggcccagatcagctttgcacacggttggtgctgacctcaaatgcagccctagaggggcctatctctgccctgagtattgaggtgcaggcttcttcccctttgttctgtccatttccaaaaatgtgaacacacacctcctacatgtttatattattgtgtgcatagatactaccattgtaacattttttgcggattaaaaatgcactattgtattgaaaatttcaaaggaaatgtgtaataaaacatttaaaattaaaaa

SEQ ID NO: 82924 - DNA, 346 bp, Homo sapiens
ctgagaaacactaaggatccatggccaccaccagaagctcagaagaggcaaaggaggatcttctctacaggcttcagaaggagcatggccctgccaacacctagatttcagactttagcttcgtagaactgagagacaataaatttatgttatattaagcctctcagttttgggtatttttttatagtagcatgacaaaatttttacaaaaaacaaaacaaaatttgggttacactaaatattcccatactgttttacgataatttcacctttctatttcacttgctatattttgctacagaatgaatgcaagaattttatcaaattttcctccaactcatccagg

SEQ ID NO: 82925 - DNA, 368 bp, Homo sapiens
gaccaaccagagcaggcaaactctaagtacaaaggcacatgtgacaggcgtgtaaccggtgctcacccacagctgggaacacaagacagaaaagatagctgtggcccctgccctcaagaagtgtacactgtttcttccttatttctgtttcatcagcatctgacatatagtaggtgctcaataaaggtttggagaaattgatgaaaaagaggcaagatgagaatatagagagaagacgagaaaaaagaagattccatctgggtcacaggagctgcctggggagagaactgggccttcaatgataggtggggttgcttagggggggccttgggtgggggagccttgggtggggggatgcagtgcatccc

SEQ ID NO: 82926 - DNA, 884 bp, Homo sapiens
aattttttaactccacagaagatttcagtttgcttctactgagaaattgcttctactgagaaataggatttgtcatctacctgggaactttctagagtccaagctcaattggcaaaagggcaaatgctaatatgcacatttgcccttttgcatctccaagtgcatactacttactgttcaggtttcaatttaccctttttttgtgcagataagagacagatggtgagtgtggaaatgaaggttgggtgtcggtaggttctggtagattttccttacttttttgagctcagcaatgtgataacagttttctgctgggatttattgggcctttcagggatatacagtattaatatatatattactggaaaaagatgttcagtttttaagcttttccttttcattcattcgctcattcatttattcattcattttgagacaagatctcactctgtagcccaggctggagtacagtgacgtgatcacagctcactgcagccttgaccatctgggctcaagcgatcctcccacctgagccttctgagtagctgggactaaagggtgtgaggtggcaagatcataactctctgcagccttgaactcctgggctcaaatgatcctcctgtctcagcgtcctgagtagttgggactacaggtatgctccaccatgcctggctaacctattttagttttacatatacaaatctctgcacatttcattgtgacagcactaaaaattaaaaaaaaaattcttttgtgtttttctgtattaatgtttaattttacataacctgttgtgattctcagtttgtgcacctcttttggactatttgagtctcctgatgtacttgatttatcctgatggggttttgtgtataagtggaatt

SEQ ID NO: 82927 - DNA, 1859 bp, Homo sapiens
gaattccggcaggcacaaactcatccatccccagttgattggaagaaacaacgatgactcctgggaagacctcattggtgtcactgctactgctgctgagcctggaggccatagtgaaggcaggaatcacaatcccacgaaatccaggatgcccaaattctgaggacaagaacttcccccggactgtgatggtcaacctgaacatccataaccggaataccaataccaatcccaaaaggtcctcagattactacaaccgatccacctcaccttggaatctccaccgcaatgaggaccctgagagatatccctctgtgatctgggaggcaaagtgccgccacttgggctgcatcaacgctgatgggaacgtggactaccacatgaactctgtccccatccagcaagagatcctggtcctgcgcagggagcctccacactgccccaactccttccggctggagaagatactggtgtccgtgggctgcacctgtgtcaccccgattgtccaccatgtggcctaagagactccccaaagcagttagactatggagagccgacccagcccctcaggaaccctcatccttcaaagacagcctcatttcggactaaactcattagagttcttaaggcagtttgtccaattaaagcttcagaggtaacacttggccaagatatgagatctgaattacctttccctctttccaagaaggaaggtttgactgagtaccaatttgcttcttgtttacttttttaagggctttaagttatttatgtatttaatatgccctgagataactttggggtataagattccattttaatgaattacctactttattttgtttgtctttttaaagaagataagattctgggcttgggaattttattatttaaaaggtaaaacctgtatttatttgagctatttaaggatctatttatgtttaagtatttagaaaaaggtgaaaaagcactattatcagttctgcctaggtaaatgtaagatagaattaaatggcagtgcaaaatttctgagtctttacaacatacggatatagtatttcctcctctttgtttttaaaagttataacatggctgaaaagaaagattaaacctactttcatatgtattaatttaaattttgcaatttgttgaggttttacaagagatacagcaagtctaactctctgttccattaaacccttataataaaatccttctgtaataataaagtttcaaaagaaaatgtttatttgttctcattaaatgtattttagcaaactcagctcttccctattgggaagagttatgcaaattctcctataagcaaaacaaagcatgtctttgagtaacaatgacctggaaatacccaaaattccaagttctcgatttcacatgccttcaagactgaacaccgactaaggttttcatactattagccaatgctgtagacagaagcattttgataggaatagagcaaataagataatggccctgaggaatggcatgtcattattaaagatcatatggggaaaatgaaaccctccccaaaatacaagaagttctgggaggagacattgtcttcagactacaatgtccagtttctcccctagactcaggcttcctttggagattaaggcccctcagagatcaacagaccaacatttttctcttcctcaagcaacactcctagggcctggcttctgtctgatcaaggcaccacacaacccagaaaggagctgatggggcagaatgaactttaagtatgagaaaagttcagcccaagtaaaataaaaactcaatcacattcaattccagagtagtttcaagtttcacatcgtaaccattttcgcccggaattc

SEQ ID NO: 82928 - DNA, 1874 bp, Homo sapiens
gaattccggcaggcacaaactcatccatccccagttgattggaagaaacaacgatgactcctgggaagacctcattggtgtcactgctactgctgctgagcctggaggccatagtgaaggcaggaatcacaatcccacgaaatccaggatgcccaaattctgaggacaagaacttcccccggactgtgatggtcaacctgaacatccataaccggaataccaataccaatcccaaaaggtcctcagattactacaaccgatccacctcaccttggaatctccaccgcaatgaggaccctgagagatatccctctgtgatctgggaggcaaagtgccgccacttgggctgcatcaacgctgatgggaacgtggactaccacatgaactctgtccccatccagcaagagatcctggtcctgcgcagggagcctccacactgccccaactccttccggctggagaagatactggtgtccgtgggctgcacctgtgtcaccccgattgtccaccatgtggcctaagagctctggggagcccacactccccaaagcagttagactatggagagccgacccagcccctcaggaaccctcatccttcaaagacagcctcatttcggactaaactcattagagttcttaaggcagtttgtccaattaaagcttcagaggtaacacttggccaagatatgagatctgaattacctttccctctttccaagaaggaaggtttgactgagtaccaatttgcttcttgtttacttttttaagggctttaagttatttatgtatttaatatgccctgagataactttggggtataagattccattttaatgaattacctactttattttgtttgtctttttaaagaagataagattctgggcttgggaattttattatttaaaaggtaaaacctgtatttatttgagctatttaaggatctatttatgtttaagtatttagaaaaaggtgaaaaagcactattatcagttctgcctaggtaaatgtaagatagaattaaatggcagtgcaaaatttctgagtctttacaacatacggatatagtatttcctcctctttgtttttaaaagttataacatggctgaaaagaaagattaaacctactttcatatgtattaatttaaattttgcaatttgttgaggttttacaagagatacagcaagtctaactctctgttccattaaacccttataataaaatccttctgtaataataaagtttcaaaagaaaatgtttatttgttctcattaaatgtattttagcaaactcagctcttccctattgggaagagttatgcaaattctcctataagcaaaacaaagcatgtctttgagtaacaatgacctggaaatacccaaaattccaagttctcgatttcacatgccttcaagactgaacaccgactaaggttttcatactattagccaatgctgtagacagaagcattttgataggaatagagcaaataagataatggccctgaggaatggcatgtcattattaaagatcatatggggaaaatgaaaccctccccaaaatacaagaagttctgggaggagacattgtcttcagactacaatgtccagtttctcccctagactcaggcttcctttggagattaaggcccctcagagatcaacagaccaacatttttctcttcctcaagcaacactcctagggcctggcttctgtctgatcaaggcaccacacaacccagaaaggagctgatggggcagaatgaactttaagtatgagaaaagttcagcccaagtaaaataaaaactcaatcacattcaattccagagtagtttcaagtttcacatcgtaaccattttcgcccggaattc

SEQ ID NO: 82929 - DNA, 152 bp, Homo sapiens
ttctggaggccagaagtctgaaatcagaaccaccgggccgagtcaaggtgtcggcggggctgtactttttctggcggagattctgttccctgttttctcaagcttttcggggccactggaattccttggtttgtaaccacatcactccaatc

SEQ ID NO: 82930 - DNA, 403 bp, Homo sapiens
cccattgtttaagtgggacttctatctacttggcaggttgttttgtaaattagagataatatgtactaaaatgctcagcacaggaagtggtacaaaccagcattcttgtggtgatgtaatttaacgtcacccttaaattctgatcaggaagaagaaagaattagtaagcttgaagacaggctatttgaatacacagtcagaaaatacaaaaacagtaaaagaatgaagcatgcctgcaggatctagaaaatggcctcaaaggggcaaatctaagagttattggccttaaataactcttaggaagtagagaaagagacaggggtagaaagtttactcaaaaggccaataacagagaacttcccaagtctggagaaagtatcaatatccaagtacaagaaggccg

SEQ ID NO: 82931 - DNA, 213 bp, Homo sapiens
tctaatgaggccctgcgtgctgtgtcatcccatggcggaagaaggaagggcaagagtgggtgagattgtgagcacgagagaaggctgaacttcatattttaacaacccactttcatgattatgataatcttcgcatttatttttttcggtctcttcatttctctaacttttctctggggttttggtcttttgcttcttcatttttagaagctc

SEQ ID NO: 82932 - DNA, 311 bp, Homo sapiens
ctttctgaatactaactctgagctcggaagcattaaagaaatagtctgtagggctattgaaaaaattgatgcctaagtccctctccagttgagttcgttcagaatctctgggatagagcccaaccaagcaccatagttttaaaattcacatttgggcctcgctgatgaaacactgagctcagtgagagcagagaatgcatctttatcgtcttcgtgggcccagtgcctaccacaggcctggtacagagtgggtgctttgtaaaatgaaactttacttttgtattctgattgtgtaagtctaaaatatgtac

SEQ ID NO: 82933 - DNA, 560 bp, Homo sapiens
atttaaactgacttagcagataatacagtgctagtttgccaacgttagtttgccaactgtcagtgtaagaaagccgagatcagcaaacttttctgtagagccagattctaaataatttaggctttgccgccacatggtctctgtcacaactactcaactctatcattgtagccacaaaagcatccacagacaatacgcaaatgaatgaatgtggctatattccagtaaaactgtatttatggacactgaaatatgaattttacataaccacgtgtctcaagattttaaagtttttttcaaccatttaaaaatgtacaaacctaatcttagtttgtgggctacacaaaatcatacagtagacaatacatatcatacatatccaggcaagaggataaatctgccggtgaagacattaggcccaagtgactagaacatgagccgcaaattgaaataattctaatcacagcaaatttcactgatttctttctaggatgattccggatagcatcttctccacagctcattttgatacttgatcttttattgcctgagttagttgt

SEQ ID NO: 82934 - DNA, 391 bp, Homo sapiens
aaactgagatactttgcctagtaactggagttcatatgtaggaaaacttggtccacaatccatatgtgtggctgccatgctatcctgagtcttatataaccaaatacaagcataaatatatttcttagtgatatataaacatataaccactattttacctgtatatctttcaaagtggcattataaatttctagttaccaaaaacttcatattgcttttatttcctgaaatcatgtacagtgaacttacatccttctctgtgtataaaaaattcctagtttttaaaattctgtgcatgtataagcattaaatctaccaatatttggctttatatatatttaaccaaaactttgctctaagtaaataaagcttgtaggtgattcctcggttt

SEQ ID NO: 82935 - DNA, 414 bp, Homo sapiens
  misc_feature (5)..(5): n is a, c, g, or t
acttnggctgattccacaagctactcacaaaatcagatcattattttgtaatcacatttgtgggtttagatgcctgagagaccttctgaaccatcaccgttttgggtgcctgtgagaatatttgaaactaccggccgggcgtggtggctcacgcctggaatcccagcactttgggaggctgaggcaggcagattactggaggtcaggagttggagaccagcctggccaactgatgaaacaccatctctactaaaaatacaaaaattagcccagcatggtggtgggcacctgtaattccagctactggggaggctgaagcaggagaatcgcttgaaccgaagaggcggaggttgcagtgagccgaaatcatgccactgcactccagcttgggtaaaagaatgagactccatctca

SEQ ID NO: 82936 - DNA, 84 bp, Homo sapiens
tagtgtcttaaagaacctaaaagctgggaccagtaaaatccacagaaattcactcttgcctttaagaacttttgaaaactgttt

SEQ ID NO: 82937 - DNA, 723 bp, Homo sapiens
gagtgggggacctggagggaggtggtgaaatagaatggtcctgggggacgggactccaggggtttgacgattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaagatcactttagtggcagcatgaagaaacgatttgaacaggaggatg

SEQ ID NO: 82938 - DNA, 801 bp, Homo sapiens
aaaaatctctgaattattattttaatgtaggaacagcctatcagtgaagcaaaacatgccttacaggtccttatgggaaaattctgtttccacttccgtttcccattgcagagcaccttctctcagggctgttctcaggacttctccctgggcctcctgcaatgaggctggagctcctcctctctgtgagggtgggagcctctgccacctctgaccagtgtcaacctcagtggacctttccttaagcaggggaattttgtgtttgggataggactgcttcagtaaggcgcagaggtcagaatgatacccatccttgccgagtttttttttcttcgtgtgtgcctgtttcatccaggtaattacatttaagtatatttacatttaaatacactgacattcatccagttaattacatttatcaaacattttcctcttaacgctaaagagcttatggttataatagtagacagaagaccttgatatcactgagagaaaagcacttttaagaagtaaaatttggccggacgtggtggctcatgcctataatcccagcacgggaggccaagacaggtggatcacctgagatcaggagttcgagaccagcctggccaacatggtgaaaccctggctctactaaaaatagaaaaaattagctggccatggtggcgggtacctgtaatcacagctacttggtgaggcaggagaatcacttgaacctgggaggcaggggttgcagtgagccaatatcgcgccattgcactacagcctgggcaacaagagcgaaactctgtctttaaaaaa

SEQ ID NO: 82939 - DNA, 483 bp, Homo sapiens
acttccatgaaaagtttaatgttcaggttgagtctttacattgctactactaaggtaacataaccctgtttgaaaaaaccaaaatctcaatgtctcatctgtgacaggatcgtcttagctgtattactgtatttttcaatattactttcttttctttttaagacagagtctcacccagtctgttgctcaggctggagtagagtggtgccattggcttactacaacctctgcctcctgggttcaagccattctcctgcctcagcctccctagtagctgggactgcaggcgcccaccacgacgacgccctggctctactaaaaatagaaaaaattagctggccatggtggcgggtacctgtaatcacagctacttggtgaggcaggagaatcacttgaacctgggaggcaggggttgcagtgagccaatatcgcgccattgcactacagcctgggcaacaagagcgaaactctgtctttaaaaaa

SEQ ID NO: 82940 - DNA, 652 bp, Homo sapiens
tttcaggagaaatgataccagctttttttgtacctctggtagaattcaactgtgactccatctggtcctgggctttttttgattgggaagccatgtgacttcatcctccgtggctctggtggtctcttcgacatctgtgagatactcactaaaagctggttgcgctttgagatctgggcgcctgctggaacctggagccacaagtcttcattcatgctaaagaactcctgtcttggtggagtggctcggctggcccgtgtatgggaacccatgaggctgtccgcgcatcccgaagtgtgaccttccaggcccacagggtggctggcgctgggcttcttcgtggcccgcgacagtccggccaccttcatcggccagtggcgcacggatctgggcgactccgaagtgctccgcgagctggcaagggagacactgggactctgcacccgctcagctccccaagataaaggcctcggaggggaagttccgcgtgggagactccggcctgttggtctctgtgctggtgcgggggagccgcgtgacggcgcgcgtgggtgtggcgacccgctggagcgctacctggaccgtcaggacccgcgctgccgctcctccactacccactgcccgcccccgtcgagggtccgcaccctgtccc

SEQ ID NO: 82941 - DNA, 484 bp, Homo sapiens
gggggcgaaggggcagggagattctgctgactttgatgggacccttgtgaacatgccctgaaataccatggatatttacagaaactggagtctgggcttcttatggtcttcaaatgttttagcctgggcagttgtccccacacagtggtagctggtcctatgcactttgttagtggctaaggaaaggtttaattgtcattaaccagttccccagtcctacctcatcagaagtaatgggtagagtgctagtccccttgatgaaacccactgagcacttaggccatcacaggcactgtactgagcatgcctgatttcatttagttgtcaacagccctatcagtgaggcaccactatcagtcctatttaacaaagagaaaaatgagacttaagggaagttatataaactgtttgagattagatagctcgtaagtggcagagattggattcaagtctaagcttatctatgtccctattctaaatttct

SEQ ID NO: 82942 - DNA, 627 bp, Homo sapiens
attgacattccatgacttttatttcttagaggccttccaaagagcaaagaaaacatttcccttatttttcaaaatggaataaaattcatcctatctagcaagatttacatcatgggatcttaaacattttgctgttttatcattctgtgaattatttcctctatcacgtattcccaactatgttaaagactaatataattggaaaatggaagaatgttggaatcacctacaagggtggtacagtagtgaaataactagatgatattgcattgcccaagtatcatatcttctttcaaaaagctagaaaagaaagtagagacactaacttcatagttggcttttagttttccttcaacacagttgagaatgcaaaattgttcattctctgcccataccagcaaaggagaagaaagttgacacaggaaaatgtttcccaattatcagatagatcataagatgaatgcaaaaagcaccgctctagaccaatgataatgttgaaattgtataagcagaaaatctcaggctacaagtcttcagctgataatgtcctacatgaatttttcaaactgaagaatcaatacataatacatttctaaggattaaaaaggaaatatgccattctcattc

SEQ ID NO: 82943 - DNA, 481 bp, Homo sapiens
gctggccctgtcagaattcatcttgtctaaatgggaagaggttaggcaagtttctagaatgccagactgctttctagaaagtcaaagataattatactttctgccacgactgtgaaaatgcccatttcattgcacgctttctaacatttataccaatctgataaataaaagctggtacctagaagaaaaaaaggctgggtatggtggctcatgcctgtaatcccagtactttgggagaccaaggtgagtggatcacctgaggtcaggagttcgagacaagcctggccaacatgatgaaaccccatctctagtaaaaacacaaacattagccgggcatggtggcaggcccctgtaatcccaactactcgggaggctgaggcaagaggatcacttgaacctgggaggtggaggttttagtgagccaagatcatgccattgccctccagcctgggtgacaagctgagactttgtctcaaaaaaa

SEQ ID NO: 82944 - DNA, 1364 bp, Homo sapiens
ccctctccttcgtccgctccatgcccaagagctgcgctccggagctggggcgaggagagccatggaggaaccgggtgctcagtgcgctccaccgccgcccgcgggctccgagacctgggttcctcaagccaacttatcctctgctccctcccaaaactgcagcgccaaggactacatttaccaggactccatctccctaccctggaaagtactgctggttatgctattggcgctcatcaccttggccaccacgctctccaatgcctttgtgattgccacagtgtaccggacccggaaactgcacaccccggctaactacctgatcgcctctctggcggtcaccgacctgcttgtgtccatcctggtgatgcccatcagcaccatgtacactgtcaccggccgctggacactgggccaggtggtctgtgacttctggctgtcgtcggacatcacttgttgcactgcctccatcctgcacctctgtgtcatcgccctggaccgctactgggccatcacggacgccgtggagtactcagctaaaaggactcccaagagggcggcggtcatgatcgcgctggtgtgggtcttctccatctctatctcgctgccgcccttcttctggcgtcaggctaaggccgaagaggaggtgtcggaatgcgtggtgaacaccgaccacatcctctacacggtctactccacggtgggtgctttctacttccccaccctgctcctcatcgccctctatggccgcatctacgtagaagcccgctcccggattttgaaacagacgcccaacaggaccggcaagcgcttgacccgagcccagctgataaccgactcccccgggtccacgtcctcggtcacctctattaactcgcgggttcccgacgtgcccagcgaatccggatctcctgtgtatgtgaaccaagtcaaagtgcgagtctccgacgccctgctggaaaagaagaaactcatggccgctagggagcgcaaagccaccaagaccctagggatcattttgggagcctttattgtgtgttggctacccttcttcatcatctccctagtgatgcctatctgcaaagatgcctgctggttccacctagccatctttgacttcttcacatggctgggctatctcaactccctcatcaaccccataatctataccatgtccaatgaggactttaaacaagcattccataaactgatacgttttaagtgcacaagttgacttgccgtttgcagtggggtcgcctaagcgacctttggggaccaagttgtgtctggttccacaggtaggtcgaatcttctttcgcggtttctgggtcccagcgaggctctctctcctgggcaagggcaat

SEQ ID NO: 82945 - DNA, 779 bp, Homo sapiens
agtaggatttacttaaactggaggaagcagaaaatgcactccagtgttgttacccaatggagtctgctacaaaaggaattcacaggggtccactctgtttgtcagggtgctggtttcctgtcattagttttcattactctctttcatcctacatgtgtgggctcagcaactttgtgaattctggtttgtggaatttgacacagatgatttctctgccaacattgaatctcacaggtcacatcttccatcctaacctatatcctaacttttctacccatcttggcattgtctttgtattttgccttgtgtaatttggactgcactggatatagtctttggtcatatcccctcagcattaggtgtgggcagcaggcatggggcatcgtgcattagtaaccagctcagcccacagatgctgtccatgagcttcctgtcccctacccttccccaaagaagggcatcagccagttactcccaacagtagggtcactcttctcagagaactattgggattacttacatcgctcggttgttacgcacactacacaacagggaaacttgttcattcctccgtcccaaggtttgtcaatctagagtagactgagtgttcttctgagcttgcaattcacattattggctggattcttctggggacatggtcagaggagctcactatggaatctgtgcattaaccactcctgatcctataggctgtatttaccagcttgttctagcatcagcacaggttatggtgatagtcgtacagtgaccatatccaa

SEQ ID NO: 82946 - DNA, 382 bp, Homo sapiens
gtcttagcttaggtggtttatctgaaacaaacaaaccaaaatcacagtgacttaacacagtggaaatctaaaaggagtgttctcaattgtcaggcagctcttcagtggagatctgctgtcttctgcaggcaccatggaaggggagtggggagagacacccccatgcctgagcacatcacccagcacttcccacattgcttctgcccacagaccatggatgccactaggtgcctgttccccctaaatcctggggccggggtggctaagacatggagtggtggctgggctgatgttctccaacagcaattctaccctgggaagcgggtggacagccagacccaaaatgtccaagttgcacccacaggaactgcttctaacagat

SEQ ID NO: 82947 - DNA, 790 bp, Homo sapiens
ctcctcaagaagagtccggtattgcagtatctcaactaccttgctcagatcctcattgccatgtctcctcttagcaacaacagtttgttcctcgaatattccaagaaccctctgagggaattcctacacaagggactgcatgtttctctttccaccgatgaccccatgcagttccactacacgaaggagtctcgttctgcactccagcctgggcgacagagcaagactccatcaaaaaaaaaaaaaagatattttgagagaaagagaccacaagtcttcaggggctagaacacccatggagctgtcgtctcctgtggtaacagtgccttcttctagaatgcctcctagatgacctgcctgaggctgtttacagaatgtacaagaaaaactgtctccatggtaggaatttttgttctaatcagtccatggaaagaaaaagctattattgaacttcccaggaaatctcccaggctgagaagtctacacaatattcaggctctgccctgccctgcgcagagcaggaagagtgcagggaggattcgtgagatgccagttctgataactttcagatgtggaggcattaccctctgcattgctagggctgaaggtcatggctaattggcatggctgctcaaatcatctctgggagtcgcctcatggaaatcttgcaaagtggaggacccagtgggagaacagcaggattctgataatgggctgaagataatttcactggctcaccttgggccttgtttgctggtgataaaataaagggtaggagctcagcaaccaa

SEQ ID NO: 82948 - DNA, 818 bp, Homo sapiens
gtcgctggtccccggcaacacggctcaggcaaacgtaagcggcttgtcgcagaaaccaaggggtccacgaaacgcgctaggctagaaggcgggaaggagagattactgacagccgtgccagccaataaaatagaaatcaacagtgagagctcagaaattcccagactgttttgatgataaggtccaagaacttgccatgtgatccatcactactagactcccacaactgcattagatttgttcaggattttcatataattttcataactggctaagttctgaaataacccatcttgaagacataaacaatgtgcattgatggctagccagactctgtcctgccacagttctcctcctactcttcatttcttaccccaaggagtagtaaacatgaatcctgacccaccaatgcagtcccagaactgagaaaagattcactgcagctaaacagattatttttgcacctttggaaagcaactgaaaaaggaagcctggaaaaaatcctgcctaacaaagcagcagtactcaaatagctttaactataagaaagaactgattcaagatatgagaagagatttaagatataagattaaatataagtgtaaatgatatcctcatttttattgaaatgctgtgtattcctattatttcagtgaaatgttaaatggcaaaggatgcattttttagattatttttttcactgaattttaaacagtctttgaagcagatatttcatataacaatatccagaaacaataacacatatgtggataaagttgagtggttggataatgtattgtgcaaattatcaagaagaa

SEQ ID NO: 82949 - DNA, 363 bp, Homo sapiens
gtcgctggtccccggcaacacggctcaggcaaacgtaagcggcttgtcgcagaaaccaaggggtccacgaaacgcgctaggctagaaggcgggaaggagagattactgacagccgtgccagccaataaaatagaaatcaacagtgagagctcagaaattcccagactgttttgatgataaggtccaagaacttgccatgtgatccatcactactagactcccacaactgcattagatttgttcaggattttcatataattttcataactggctaagcattggaaatggatggggagaaggcctgatgaaaattactgaggaagcctcttagcctatgtgctctgagagtagtgacacctagca

SEQ ID NO: 82950 - DNA, 812 bp, Homo sapiens
ccagttggttttatctgatgaagcaaagcagagaaaatagacctacagtccatatgcttcaagtctattgtgtcttgatctaagaagagatgcagaacagatgctaagaagacttagacgcaatgagccccagaaacagctggagtgcagtggcgtgatcttggctcatcgcaacctccgcctcctgggtgcaagcgattcacctgcctcagactccggaagacctgagattacagggggtatccagtacaatgatgaatagaaatggataaagcagaaacacttgtgttattctcaattccagagatatcctttaccaaataaagaaaattctcttcaccaagaaatggatcatggtggtattctgatccgagacttctagattccaaaactgtgagaaaaaaaaatgtctgctgtttaagccaccttgtctttggtgacaacccaggctgattaagacagttatcatatattatttatttacatattactagattctatgtaacattttgttaagttttatgtttacaagttatttcatattttatgtcaagtttttttaagggttttataaagattttgctgccctcatgaaacaattaggtaacatttttctatgttgtgaaagtaaaattggtatcatatcttcttaaataattgatttaaattaaaatttaccagtaaaattactgatgtcttgaatttctttgtaggaagacttatgggagtagattcagtttattttacaggtgtttcctgtcacttttctggtgaattccagtgttctttcttagatgacctatttagagtgt

SEQ ID NO: 82951 - DNA, 485 bp, Homo sapiens
  misc_feature (417)..(417): n is a, c, g, or t
cacgtggctgtaaccccagctactggggaagctgaggcaagagaattgcttgaacccgcgaggcggaggttgtggtgagccaagattgtgccattgcactccagcctggccaagaagagcaaaaagtaaaaaagaaaaaaagaaaaaagaaaagaaaaagaaaaaaagaaaggggatgctctaatctccatgccttattattttatcttctcaattaattcaaaactaaggcaggaaagagcatcctatttaacaggccccctcaaattccaacctgtgttcttcttcttcttttttttttttttttttcccggggggtaacccttaagggaaaggcggggtcaggggtgtcacaattctcccaaagaccccctgtgaagaaaatagccctcacaggggttacctatagaggcgggncagcctggtggaagcaagcctggctgagggcacagttggtaggggcctagaagaggcgtgcacctcta

SEQ ID NO: 82952 - DNA, 563 bp, Homo sapiens
atctagacgatccctgttactggatttatactaattagtataagtctcaggtaacccagaaagaggtggtcatcctaacgagaagttcaagggcaataaggatggtaatcaggaaagtctcatgcctcaaaagtgcccaagataaatgtccaccacctaaagggcaaagccagtggtcaccttgtaatcaatccaccagcagccatcccaaagctgattttcccacctttaggcgacctattgcacagcccttgataatccctaggcagaatcaatggcttgtggagctttccaggttatgttgcagaagcagtgggactcgggatggtgagtgaatgtctgacaggctgaaaggtcatctgcaggggttctgagactgagctagtcttcaggatgacctcaaatctcatcctctctcaaaggtgagagttaagggtgagagtcttgtaaatggactatcagtaccttagaaggaatccttacatgcattcatgcagtcaacagcgaggggagaaggctgtttcctttcccccatctctttcctgtacaataaatacagtatt

SEQ ID NO: 82953 - DNA, 504 bp, Homo sapiens
ctttgcaagcacctgtcataccctgtgtatatggatatatgggatagaggccatacaggtcaagtgggcacaaaaatgcttagggacgaaatgacacctaatttttaaatcatgacaggatgtttaaggttataaagcatactaatatatttaaaattctaatttaagaagagtttttcttcatgtttgcaatgttacagtgttctctatttcatagacatgcttttttttttttttaagtttatcatgcattgtggttgaaaagcagcacacaatttatggcaaggaacacagtgaagtttataatgtgacaatgtgataatagccaagactgtcaaaatatgccagccattctctgtaattaggctcatttgtgttcttaaacttgagatgcatgtataaaaatatcattttcttcctgcttgctttctggcagtcttgtgtgtttttactgcactgtcacgttgtactgtagcaacgttatgctttctaatcaagatttgg

SEQ ID NO: 82954 - DNA, 421 bp, Homo sapiens
atttggtggctactttcaggggcccacctcagcaggccaaggcatagttggagggacaccagatgctctgagctggtatcagatccctgtttgccgctgggcaaaggcagacaaaagcaaaacacgaaggctggccagctgaatgttaggatatgggcaggaggagagggctggagttgaattgtgcccaagactggtatgggaactcctgagaacagagagagcaggggtgtagcagggggccagggaagaaataaatacttcttctctaagcctaagccagttttacccaggagaacaggagctattctccccaccctaggcccccatctgctttgaagctacacctgctcttaactgccaggaatcttgcctgtggggtggagtacggggtatgcgggtatgaagtaagaacctagag

SEQ ID NO: 82955 - DNA, 219 bp, Homo sapiens
cccaggctggagttcagtggcgcgatctcagctcactgcaacctccaccccccgggttcaagtgattcaaattgattacatcaagatttattattttaaactgcaagaataaatctataaatgtctgcttttttaacagtaaagagtctgtcttgaaataatgtttcttgtaactaaaacttatggtgaatttgttttaaccagatggttgtgtgtttg

SEQ ID NO: 82956 - DNA, 496 bp, Homo sapiens
aaaagaaaagggaaagaaataggaggcaccataaacaaaaatgttagcatttttccttgtaaaggagcagcctgaattttagtaccacagggatagcacggtttattagatatacttgtaaaggatataaaaatagtttgtttgcaggcttgcttgttgatcagaccgcatcctgcatccctttgtattaaatggaaagaattaggaagcatgatcctctctcagatgactgggttgaaattatgtgtggtcagagagcttaagtgaaccagttatgaagctgaagaaagggtaatttttcacttcctaaaccatggaaagattaacttaaaatgaggaattgctcaattgcataatatagcctgtcctgtgcaagtctagataaggcattcattacaattctaagttgccacctccccagagtagccatgcatcctggtttgcctgcagcagccttgccttcttctggttgccccatatagttattattagaagc

SEQ ID NO: 82957 - DNA, 333 bp, Homo sapiens
tcagtgggcatcatctgcagtgaggctggcagctcattatacagaacttttccaccctttgagctgctccaaaatggaatgagcttcttcatggaagtggaattttccatccctgaaggttttcaatcagaagctggctgatcatttattgatatgttctaaaaggacataaaagcattaatagctgttattaattgagcctaaattatttctggcacaatgatgggtttatttatttacctttaatttttacaacaaccttgcaagatatagatgtatcaccaatttatagatggggcggtcaagtgacttgtctgtggtcacacagctaat

SEQ ID NO: 82958 - DNA, 231 bp, Homo sapiens
tctataagcctttttttaaaaattattttttatctttaaaacttttttgttaaaaatgaagacaaaaacacacacattagcctagacctatacaggatcaagatcatcaatacatcactagacaataggaatttttcagtttcattagaatcttatgggaccacagttattccgtcattgattaaaatgtcgttatgtagtgtgggactgtagatatgtgctctctttgga

SEQ ID NO: 82959 - DNA, 953 bp, Homo sapiens
atatttcgtgtgtgtgttgtcccctgattattaggacactgtctcagccctgaacactgttcagatcagcttcaacttactggtcagctgtacttgctgtgcctgagtcaatgtcttgaaccacataaaacaattcatacagaaacaaggaggaagccacttggctttcgaagatagatctctgtggttagcgggatgtgcttttttttcttttttctttttctttttttgagaaggagtttcgctcttgttgcccaggctggtgttcagtggcgtgatctaggctcaccgcaacctctgcttcccgggttcaagcgactctcctacctcagcctctcgaatagctgggattacaggcatgcaccaccacgccaggctaattttttgtatttttagtagagacggggtttctccatgttggttgggctggtctcgaactcccaacctcaggtgatccacctaccttggcctcccaaagtgctgggattacaggagtaggccaccttgcctggccaatttttgtattttcagtaaagacgggtttttcaccatgtttgccaggctggtcttgaactcctgacctcaagtgatccgcccacctcggcagcctcaagtgctaagattacaggcatgaaccaccactcctggccaggccagttttactttgcacagtgtctctccatttgcttttgtctgatgtttctttataattagattcagattataacatctttggcaagaatatcaccaaagagacttttctgtgtgtccccactgcatttttcatgtgctgcacaatttcaatttgtcccagtattgatgacatttcaccttgatcacttgatttaaagtggtgtcagccaaccttcactgtcaagttactttcctctttgtaattagtgtttcataagttctttaaaacactgtaaatatcccattcttcatcaaccttt

SEQ ID NO: 82960 - DNA, 958 bp, Homo sapiens
cttagctgttgcaggagacgtggtgaactctgccctatataatgtggatgctgagcaaagagctgtcatctttgaccgattccatggagtacagaacactgtggtacgggaagggactcactttctcattccatgggtacacaaacctattatctttgactgctgttcttgaccatgtaatgtgccagtcatcactgatagcaaagatttacagaatgtcaacatcacggtgcacatgggggcctgtcgctagccagcttcctcgcatcttgaccagcattgaagaggattatgataagcgtgtgctgctgtccatcactactgagatcctcaagtcagtggtggctcactttgatgctggagaactaatcacctaaagagagctggtctccaggcagatgagcaacgaccttacagagcaagcagccacctttgggctcatcctggatgacgtgtccttgacacatctgaccttcgggaaggagttcacagaagcagtggaagccaaacaggtggctcagcgggaagcagagagcaccagatttgtggcagaaaaggctgagcagcagaaaaaggcagccatcatctctgctgagggcgattccaaggcagcagagctgatcgccaactcactggccaccgcagggaacagcctgatagagctgcgcaagctggaagctgtggaggacatcacattccagctcttatactctgggaacatcagctccctgccagcggggcagtccatgctcctccagctgcccctgaggggccaccctgcctgcacctccgcaggccaactgggccacagccctgatgattcttaacactgtcttccttctgccccaaccctagaaatcactatgaaatttcatgattggcttaaagtgaaggaaataaaggcaaaatcacttcagatccgccccctcccccaaaaaaagcttgaaatattatgaaa

SEQ ID NO: 82961 - DNA, 466 bp, Homo sapiens
ctgtgtttaccaggctggcctttcaagaatcttgaaggtaccagaaggtctgatacttgatcattgtactaacttgtgcttctcctgtagtgagagtcaggatcatggcttggtctacaaaaccagcctttctggggcacgtgtaggaatctgacaccacgtcagctccaggagacctgagggggaggtggggccattagaatcccgctccaggagcacacacacgggctctgacgggggtaccctgcacgggtacagggagtaccaacagccagtggtctggggtcgaggctgtgaaactggcattttaggttggtttgaatggctcagtgagaccgggcactgtgggtcactcctgcaatcccagcactttaggaggctgaggtgggtggatcgcttgaccccaggtgttcgagaccagcctcggcaacatggtgaaaccccatgtctatgaaaaatataaaaa

SEQ ID NO: 82962 - DNA, 508 bp, Homo sapiens
aattactgttttttaaaaaaaaaacactaaaacttgagatcatttattacatagcaatagataactggaaaaacctctatcctgctatatcctggccatactgttatatccatgggccccagccaatgttagctatagatagaaaagggattggagagttgcagtacagaatccctggatggaagtcagtagaatataatggcttaagaacatgaattctaaagagacaagcctcagttagtatgctggatctaccatttataagctgtgaacctggacaattacttagccttcttgtatgtatgattccaatgatatgacattccaactatgtaacatttttcttcaaaattaacagaatgagatggcagaaacttcattcttaagtagaactaagacaagaaaggaaagaatcactcaatttctctagctattctaccagaagcagtctatttctgatttggccattttcaaaaaatataatataaaaataggacagttgtgcctg

SEQ ID NO: 82963 - DNA, 279 bp, Homo sapiens
ccttaggactcctcctgactccttccaactcccaagtctgcagcccaggtaaagccagagcagacttaaggcaagttttcaggaaaccaggaggcttgatccagactcacaatctccctgcaaaagtgttcagaacacaccgcacaaacacacacacgcctcacaaaacttctgaatgttgctctgtctccaccttctccagtcaccgaaagacctcggcctgaattggagcccgcagccgtagctgtccctctccacctgtcgccctcgcggaggctt

SEQ ID NO: 82964 - DNA, 504 bp, Homo sapiens
tctctacaaaaacacaaaaattagctgggcgtggtggtgtgtacctgtagtgccacctccccactagctgggactacgggttggcttggcttccatggctgtgggggcttctggttcatgccctttcctcctttctctcttgttcagtgttttcctccatagaatggctaaggccgtgccagccacctgaaaggagctgagttctagcctctactgattttgcgtgtgagctccttgccactccaaaatttttcttagccagagggccttgctgtcacttcttttgacttgctcatccatgctccctcagaaggtcctggggctcttcctttgatagccccttggcaagactgcaagctctgagctcctctcagctgcacccaaggtcttaattatcagaaagtttactcttcctgacaaggcttccatcttgccaaatattcagtagggggtggactggcaaactactgtcccaattctcgatacacatcccttagatcaggg

SEQ ID NO: 82965 - DNA, 1273 bp, Homo sapiens
tgatataatagttaactgtatctttgtttcatactcattttgaccaagggcattagttgcatggtttaacaaatagtagaaaatagcctaaacttcacatctagaaaggcttagagagggaagtggttattcctgagatcacgttgctagtaagtggcagaaaaggacaagaacccatgtgtcctgactccagaaggttggccagctatcttcatttatatgggactttcctggtttttgcactgaaagtctagctttcaggaaacccctcagtcctagacaaactggaacaattggccaccttgctcctagaaggaacccagagaaagtctgtgtgtaggtatctgggatttaaagactcattctttctttaagataattatcaaatccataggcatgtactggcactaagtagagaattctcaagagtccctgctggcctgtagattttatttcattcagtttaattagtatgttttatatatcatgaggatgagtgaaactattattaaaaaagcaaattgcatagggcctgacacaagccacatgctcgataaatgtctacaagcttatgctcttaatgctgtttgattacatccctcatatacactcttttttgaaaaactagaaaaatgagtcaaaattttaaggactgatacttaggatatatagattaatgataactcctatgttttggtgagactgtaacctgatagaaaaattttggaagataatttggctttatcttgtaaaggtgagtattagcagtttcattcctcttttatatatattctagagaagtaaattcttgtagtcatgctcaaggagatggtgcaagtaagtttgtagctgtattactcatgatagcaaaaatgtggaaacagtatcaatacttattaactggagagtgaatcccatgaagtgtgatataatccatatagtggaattagtggaaaatgaatgaaccttagctacaaactttaaaacatggatcaatttttaaaacaatgttaagtaaaaataagtcttggaaatatacagtatgagtctattttatggaatcatgttccttagaaataaataaaataacccttatatatggtttgtaatacacattatataattatgtcaggggtccctaaagactagcccccaggtttgatgatttgctcagagaattcacaagactctgcacatagttgtgctcatggctgtgacttattatggcaaaaaaatactaatacaaagcaaaattgggaaagggaaaagatgt

SEQ ID NO: 82966 - DNA, 699 bp, Homo sapiens
catcaatgtcttctggtggttcaccataagccacagcagatgtcttaatctttccgagatctagtttttcagcaaagcaggatttaagaaatgtaactatcttatgtggttatgaagaacaatagaatcattgctgtataagtgctttttaacctgtaaattttgtgaagcttatcttttatgcatataaatatttgaacattttacattgtttatatttttaatcagttttactcaagtgtgattatatacaagaaaatgtaaccactgtaagggtagagttataagaattttgtcaaatgtattcacccatgtagtcacctccttatgaagagacagaacacgtacatcctcccagaaagttccacagtgctccttttccctgagtttcaccagtcctggcaaccaatgatctgcttcgtataattataactgttctagatatttgtagcaatgtaccctttccatatttattttgtgtgtgtaaggcttcttttagtcattataatatttttgagattcatctatgtttaatgttctatcagtagttgtacatcttacttgtctcagcatatcaccatatagatatactataatttgttaatctaatcactgatggatatgtaggatatttaagtttttgacattatgaataaagtggctataaatgaataaagcgactacaaatttgaatatcta

SEQ ID NO: 82967 - DNA, 385 bp, Homo sapiens
agctacagacaatgcacacataaagtgcccaagacagggtcagaatgcagtcacatgcatggctcagaaacggatgcttttctgtgtgtatgaagaaggcagtagaagctataatgtacaaccttctgcatattctattaggttgccttgatagcaggattaaagatgtactgcagagacatatgacaatatgcagttattttttcattgcagttcaccttgcaattatgcaagatgaataagttctagaaatctgttgtacaacataatgcctagagctaacaatactgtattgtacacttaaaaatttgttgagagagcagacctcatattaagtggtcttaccaaaaaacaactaccaccaccaccaccaaaaaaaaaaaaa

SEQ ID NO: 82968 - DNA, 357 bp, Homo sapiens
accactctccctgcccgccctcctcctctgtaccctctgcgctggtcacacggtgagcctgatagaggtgaacttgagcccaggggtcctctctcccagaccaagctagtccttgcttcatcactccaagtagccctcctcagtctgagtccacccctgacattgctgttctggccttcagctgatcacagctagaaactgtcggtaacattagcactaagcgctaataaccattaaaacagatgaccatttaccaagcccctactctaagccaggcgtggttataagtgattcatttctgtatcacttaaagtcatttaatcctcatcctaagaaatgggttatagtataatccct

SEQ ID NO: 82969 - DNA, 279 bp, Homo sapiens
tatcttttattaccattattctactggcctttttctcactgatttgtagtccttcccatatcctatacataatccctttgtcacagagttgcaaccatcttttcctactctttggcttgcctttcactctcttaaacatgatttttgataagcagaaattcttggttttaataaattccaatatatcattttttatggttaatgcttttttgtgtccatttaagaaaactcttcatactgtaaggtcacatagatattttcctatattatctcctataa

SEQ ID NO: 82970 - DNA, 236 bp, Homo sapiens
ctcccaaagtgctgggattacaggcataagccaccatgcctggtctgtatttttttagtagagaccaggctgatcttgaactcctgattttaggcgatcagcctgccttggcctcccaacgtgtcgggattacaggcatgagccaccgtgtccggccttaaacctgtttctgtctaagtcttctccatctcatcaataaactcagtcccgccatagtatctctggcccgggtaccc

SEQ ID NO: 82971 - DNA, 302 bp, Homo sapiens
gataagataccatccacataaattaagtgagcacattcataggtaacaaaaacatggaaaaaggaaagatacatatcagcttcataacagttgcctctggagaggaaaggaggaaactggggaagggcacacattaccaacctcaactatctgtaatgctctcttttacttaaaatctgaaataattatgacaaaatcttaacatgtattaattctggaaaattggcacatgggtatatttcaccctataaaattagtgagaaaaaattttttatttaaaaatgagagatggcggtgtgctg

SEQ ID NO: 82972 - DNA, 967 bp, Homo sapiens
aatttttttgtatttttaatagaatggggtttcaccatgttagccattatggtctcgatctcctgacctcgtgatccacccacctcgccctcccgagtagctgggattacggcctcccaaagtgctgggattacaggtgtgagccaccgcgcccggccgaggaccagcatatttcttatgattaatttggacatctgtattaactcaaagtaatatttaaaacatagatcctaatttttaagacttgaaatgtttgtaaaactttaaccaaggagaattttctgcatttagcagtagacattgattttggagtatttatattattcaaaactgctgaccttatgtcttttgtaaaacttgagcaatgaaagtcttaagagagaaggtttaaaggaaactctttgataaattaaaagttggggaaaaaaaggaaggaaaataagtagcctaaaacaatccacgtaagaacataagttcccaaggactctgtataattattatagagcccttctactgggtcttagaaatgtaggctaggagtttccagaaaattattctttaaatgtcactaggtacttgtcagtgattagtacattttaaatactgattctgattttcttaaaaataggattttcccagaggcagaggagtcaaccattcttgccactagtagactgatagtctagtggccttaaagtattattgtttgactttaaaagtcataatcctaatttaccgttagtcaagtatgactttgcgttgatgtgttttatcttttaaccagtaagcatttaccagtgatgggacaacaacatagggcattagaatccctggaaaccgtttttgtagttcatttggttgtcaaattccttttgtactttttgaggtgtacctggctagtaattttttatggaatggccctgtttttccttgttgctgtttttcctctggaatttggaatgaatat

SEQ ID NO: 82973 - DNA, 132 bp, Homo sapiens
ttgccactcactacctgggtaattttggacaacctctctgggccttgattcattcatctgcaaaacagacttgacaatagaatctatgctcattgtagagaggattaaatatgattttacatgtagatgacc

SEQ ID NO: 82974 - DNA, 506 bp, Homo sapiens
cacttttctttttaacagagtaggtaaaaagaataaatttggagcttagaagcaacaaatagaaaaccagcacgcttatccatatgaagaatgaaattagatgctttcatctaattttgaactattttactttaacatagaatggatatggttctttctaaagaccaaagctgtttaatgcattataaaagtcattactaatttcatgcatctaaagtgagggggagaaaaaacttacaagaaatgaaatggaatatctttttcacataggacaacggtggcgtttaattttaagaatgtattaatgaattgcatctgaagatacactcctactgattttaaaaatgaacatgtgaaagccatttgttatataacttcaagaactacatcaccttaattgttaccttcttagtctttgacagagttttatatttgaaaagattgatatattttgacacccttcaaacattttaaggcatttactaaatataatgtgtcaaagggta

SEQ ID NO: 82975 - DNA, 570 bp, Homo sapiens
cagttgctgtacatgcttgttcatacattgcatgtctcattgccgtcttaaatctctacccaggggtgtgttttttactattataatgagcaaagggtcattctgaggacaagcaaagtgaaaatgcacatgctctctacaggggaaagtccccagtgaaggtagttctgcttggatgagcttgattacaatgtgagtgctgaggtttgttgtgttgttggtgcggttgctatgtcccaatgaacatggttacagggctcattgtgctgttgacagtgtggttgccatgtcccaaggacgtggtcatctccttgactatctatcctgcctcagtaccatatagttcacttactaaagtatataattcgatgccctttagcatgttcacagtcatgaaactattaccacaatcaactttaaaaccttctcatcacctaaaaagaaacacaacctgaatcccctagcccttccatccctaaataatcattacaatcatgaatttgctttatgtctctgtgtgttttcccattcttgacagttcaaataaatggaatcatatactaaaaaact

SEQ ID NO: 82976 - DNA, 598 bp, Homo sapiens
catcagtgtatgtacgtgtgtgaaagagtatcaaattgtgtacagtttaaagctgctttaaaaaatgtgactcaaattgcaaaaaaatctattcctatgtaccttcttaggtattaaagccacaagagctacacaatggaaagaccataagagtggctctgtcactaactagctatgtgatcctgaacctattacttaacctctctgaaccccagagtccccacttaggaaacgaggatatcacaatctatctctgggacagtacagtgaaagtaccttccataacaagtccttactgaacatctacaaaatatgacttgtttactgtacaaagtaaagtatacctatataaagcattcattaaaacttgtgctttattactaagttacaatgtgagtaccaacaacaaacctaccttacatagtccaaaatgtacatatcactattatattttttcatctttctactttcaaactgtgtctttgtatttaaaatgctgctacacaatcccagcactttgggaggccaaagcaggcatatcacaaggtctggagtttgagatcagcctgcccaacataatgaaaccccgtctctacta

SEQ ID NO: 82977 - DNA, 581 bp, Homo sapiens
gcatagcatagtgattaagagcgtggactctggagccagactgcctggatttaaatcatgactctgccacttacaggctgtgaggccagcatgttacttttccacttagtacctcatttttctcatctgtaaatgaggataattaaatatacatgcaggcatgtgccacataacaacatgttggtcaaagagtggctatgtacacatacaacagtggccccataagattataaaggagctgaaaaattcctatcacctactgacgtcattgctaatgtcacatcatggagcaattcattattcacgtgcatgggggtgattctggtgtgaacaaacctatgtcactgccagttgtataaaaataaagcacatatagttatgtacagcacataatacttgataataaaaatctgtgttgctgttttatgtatttactatactatacgttttattattattttagagtgctttccttctgtttataaaagaaagttaataaaacagcctcaggttgctccgtcaagaggtatttcaaaagaaagcattgttattatgggagatgacagctccaggcttgttac

SEQ ID NO: 82978 - DNA, 921 bp, Homo sapiens
cctggaagagctagtcttacatgcccagttccttttcttagattcaataatcacttttcatgacgaggaatgaatttgcggtggagaaagatgtcaggaatgtgaattgtgacaaaatccttttacgtagaagcatgaagacagggatatgaagtagcagtgcatgtgagcaagtggctctgttttatctgttcactcagggccccgaggtcacctaggtttctgggatcttgctggcagtgaaaattatactgtgtctctaagtttctgcccagaggtgacacacatcacttctgcaaacattttgttgggcagagctatgtggcctaacttcaaagtgagtaggaatatctcacactaattaggatggcggctacgaaaaaaaacgaaacaccccccccaacccctactgacccaagaaaataacgagggttggcaaggatgtggagaaattgaaacccttgtgcagtgttggtgaggatatgaaatggtacagccactgtggaaaacagtatggggatttcttaaaagattaaaaatataatcaccatatgatccagcaattctgcttcttggtgtatatccaaaagaattgaaagcagggtttcaaagagatatttgtacacctgtgttcatagcaacgttattcacaatagccgaaaggtggaagcaaaccaaatgtccattgataggtgaatggataaacaaaatgtgctgtatatacatacagtggaatattatttatcctgaaaagcacagaagttctgacatatggtgtaacatgaccccttgaagatattatgccacgtgaaagaagccagtcacaaaaggacaggtactataaatcacttatgtgaggtatcaagagttatcaaactcttagcaacagaaagtagaatggtggttgccagaggctggggg

SEQ ID NO: 82979 - DNA, 214 bp, Homo sapiens
tgctccactgcgcctggcccgattcccagtttttatgatgccaattactcttggaaaatgagaagactaaacagaagaaaaaaaccccacaattaacacctaaagagctcttacttgtcaggttttattctaattaactgaaacccagggaaactctgtaacgtagagactattatcttgaggcacagagaggttaaataacttaccgagagtg

SEQ ID NO: 82980 - DNA, 404 bp, Homo sapiens
gtcattgtccaacaagaaaaaaattgcaaataggtcctaaatagaaaaagacaatggttaatatgcactaatttgtataactagaaggaaaatatttttctgtcacttcttaaaaagctcaatcttgcagcttttctctggtaactagtgatattttcagcataaggtcatgctagctgaatttaaaattttgtgtactgtatgtccttaaattttgaaagtgaaatgtttctggttttgactaaatttatcaaaaccatttcacgaaaattcagcaaacgttttctagttagctagtcccaaatcttttgctgttaaagttaaccctgaaaatttctgtaccagccaaatgaatgtgtgcatgtaaccttgtaaatgatttgaaaatgaatcatgcaataatc

SEQ ID NO: 82981 - DNA, 421 bp, Homo sapiens
catggctcccaagtgccgcaggggtccctgttttcacagtcccatcctcccacgtttctcttcagatggcttcatagagcccagagctcctctatacaaagtgtgatcattcccagtggatttcttcgctccatagctttatcattggagatctggttgatcctgacgtagcgctcaagaaagcactaaatctgaaacgtttaaaaaccaattcacgtctcctgagaacgatgttgtataacacaatttttttctttccttttgatcccaaaagaagaaaatcatgacaatattctttcataaatccattattacactattactatgacaggatattgtatgtgggaaataatgaagccatttgccgtctcttccccagtttcctttagagtttctgtgctgagcaaacctccctgcgaag

SEQ ID NO: 82982 - DNA, 435 bp, Homo sapiens
tgcctctgtcccctactaaagctctctaaaggtagagtattttatgcacatttttactaccagccccttgcatggggctggcacaaggtatatgttaataagtgttttaaatgggagtgaagtcagagaaactctttgtgaccttaatttaggcaaagatttcttgaatatgacaccaaaaaatccataaaagaaaaaaatggataaattggacttcatcaaaattaaaacttgctcctcaaaacacaccatattcagaaaatgaaaagataagttacagactgggagaaaatatttgcaagtcatttgataaagaacttgtatccaggataaacttccacaactcaataagatgaataacccgattttaaaatggtcaaaagatttaaacagacatttcaccaaagaatttatagaaatggttgttaagcacac

SEQ ID NO: 82983 - DNA, 308 bp, Homo sapiens
ggagttcaagaccagcctgagcaacatagcgacaccttgaacatcagtgatcattaaagaaatgcaaatcaaaaccacaatgagataccatctcatgccagtcagaataaaagtcaagaaacaacagatgctggtgaggctgcggagaaataagaacactagaaatagggagaggtggctgttttttcacatgccaaattttcaacaaaagatacaaagaaggcaggcatgatagcacacacctataatcccagcttacttgggaagctgaggtgggaggatcacctgagacaagggagcagaggttg

SEQ ID NO: 82984 - DNA, 344 bp, Homo sapiens
gtcgacgattagtagggtgtggtggtgcaggcctgtcgtcccagctactctggaggctgaggcagaaggattgcttcagtcaggaggtcaaggctgcagtgagctatgttcatgcatctgtagtcctaggtacttggaaagctcagataggaggatcacttgaagccaagagtttgagaccagcttgtgcaatacagccaggtcctatccctaaacaagaatttaaaaactagccagcagcctggtcaacatagcaagaccctgtctctatggaaactaaaaaaccttaaataggcatggtagcagggacctgtagtaccagctactcagaaggctgaggcaga

SEQ ID NO: 82985 - DNA, 1432 bp, Homo sapiens
tggcgaatccccaaggcggggcctccccaatccatacaccgccttcggggcctgagaccctgagagccacgcctggccctgggacttcgccctgaccccgctcctcctgtgccaagcgctctgtctcagtgtttccctgagtcttggcccaggagctgtctgagaaaccaggaagaaaccctcggcatgggccctgtccctctcccttcacttttcatccaggaatctccgtccctgaactggactccctgtccacctggactcttctagaagaaaagccacccacggagtttggtgacagagagtgagcttgctctgggaatggaggtgtagaaactgttttttgttttcctttttttttttttttttattgggaaaagttgtgcctgagtgcatgagacagaatagagaccagtttatttatttatttgtttattaaatacattggatagcagaaccttggtaacccctgaatgatcaggaatctaatcggtaaaaaatgtgactttggccccatgatgtataaatgtgcccaaaagcgttacaacaggactcacaaagcttctaagtttcacttttgcagtgtacctgtgactcccgcttgtcatattttaaatttgccatcattccatagctctgagtttctgtgtgagtccaggatatctcctcaatacaaagtagcacactgtgtactttgcaaccaggtacgttgcaaccaggagtcagtacaggctttattcacctcaaagttgcaactgttcaatgtagtcgcaatgcccctcactagtgctcatgcactgcctgtttttaggaagtatccactgctaagtgttgtgtatattttataggaacacttagtaatttttaaacctgattaacattaaaaaattagtttttaggcagacccacatgaggtattaaaggccaactgccaaggacaccctgctaggctctgtagatggatgtattaaaatccataaaacaatgtatttaaacctaagaattctgctgctttcgaattctttcctctgctccttttcttcacctcctgcttctccagcccttctctccgtccttttcatccttcaggccctcctgtccccttagtccccaccacactgtcacttgtgagttgtgacactagcactgtcccatgacctgttacgtgactgttcttttcacagtggtcctgctcctgggagtcggagtgtgtcatctctccacttaaaacactccagtgtctccacctcggtcttgagaaacttctggagtgtcaggcacgtgagcatatgaggggatatctggtttatcgtagggactaaattaatttttgtcgactgaatgaatgaaatatgagtgtattaaattgcattacagataattataaagtgcaaaacacggaaaaagttcagaaaatttttattttatgtaa

SEQ ID NO: 82986 - DNA, 820 bp, Homo sapiens
ctgtgctgagtttttcgaaggtcagagcagattgaacctttgtgctttcatttttcctgattttgatttttcttatggggatccacttttcctgcattcgaggtgacttgaagaagccttccaaaaagcgtgtgaaaagggagccctactctactaccatgttacaggtgacttcattgagcccaatcaatgaaattttgagaagatacagcctgtacaccaaccagcattggaggcatcatggcttctggagaaagaagatacagccacaagaagcctctgaggagcctccagctcacaaggacagaggaggtggagagaggccagtcaacgcgagggtggtgcgggtggcccctctgaggcctggttttgctctttgtgggtacgctgtacaagacatctctaaagaagacactgtatatgacatctgtaatgaggatgctgtagacatctctgatgaggacactgtagatatctctaatgaggcttctgtacatgacatctctaatgaggctgctgtatgtgacatctctaacgatgccgtaaacatctctaatgaggctgctgtacgtgacatctctaatgacgctgtagacatctgtaatgaggctgctgtacatgacatctctaatgaggacactatagaagacatttcttatgaggacactgtatacgacatcactaatgaggatgctgtacgatacctctgtaaaaaagatgctaccaaggagccatagaacactggagaactgattcgaaatgaggagagcatgactgatgacgaggataaggaagctcaaaggggagcaccaggagagag

SEQ ID NO: 82987 - DNA, 355 bp, Homo sapiens
attttggtttctacccatcatcctcctctcaaaggaaccaggggtccttggggatttggctgatgccaggggatggagagtgtcagttggatctgaaggggaggctcgcagcatgtgtgtggcaggtcagacagacccaagagccagcttggtggggcatccctggctaccctggggacacagtgagcgccgaactaaataacatcaggaatggatcaccacgcaatgagtaaggggaatctgagtctatagggatacagacccagaggtaaacggccatggccacccactttcctacaggagaatgtgactagtgagcgtggaacatggaacaaatggtagaggtggctgacat

SEQ ID NO: 82988 - DNA, 488 bp, Homo sapiens
cggacccgcagcttggggctggcactacttaaaacatcccgttcaagtattaccttaactgggcttgtcatcccaggtcaaatcctccgaaataagtaaaccactctaatttcttctctcctaagagactctatcagtgaaagctcacaaaaaaacagttaaaaaaaaaaaaagggggggtctcgccatgttgctcaggctggtctcaaactcctgggttcaagcgatcctcccgcctcagcctctcaaagtgctgggattacagacaggagccactgcgcccagccaaagacagttcttaaaatctacaggttctttaggatattctgagaataaatatcgtttaggatttccccaaaggatttacgttttgttctatgaagaacccagttcttccaaaaatttctacaactgacgatttggaaataaaaataacgctcatctcataaaactttgcacacagatagtatgaacctcgtaagctttga

SEQ ID NO: 82989 - DNA, 633 bp, Homo sapiens
gctaccttcccaacttctaatttgaagagcactgaaaatggagctgtgaacacttcatttttaaaacctgacaatatggtgctattgactacttaatacaaagatatattacaatatttttaggtaaatgtattaagtctggcctgggcataaatgtacatacagaaaatgtttgtagagaattcatcaaaatcatgcccatttgctgttgtagagctacagtattcttcaatggtggtgactgaccagtgagtttctacttcttacagatgggacacaacagtcatgggctgtctcagctgcccaaagcctgaggcagaccacatgagagctgtggcttcttcttggattcaggttggataacccaattcagtaattaaatatgtaaattttggggggggttggggggtgttttctaggaacttgaagagtacgtgacattataaaaaatgggtgttggaagactaattgtagaaatttgacctgagggccaatgttacttggtgtaagttcactcagacagacatgtcagaacatgcccaaagaagcctatatcttgctgctgggaaatgtaaagcagttggcatgtagaatacgataataaatcatttaagaaaccaccaaaaaaaaaaa

SEQ ID NO: 82990 - DNA, 627 bp, Homo sapiens
atcccactcatgatctctttgtcaaatgattgttcagccacactttcaggattctcttcagtacaagttttctaatttttgcattatggataggctgagaattttccaaatctccaggttctggttcctttttctttaacaatttcttctgcaattcaggtctcctcttttgcattttactataagcagtcaggaagaatgaagcttcctgtgtcctttaacactttaattacagatcttagtgatacatacccagttttatctctctcaagctctaccttccacaaaatgctagaatacagttttgctaagttcttcaccacttcatataaagggttgtcttttcttcatttcccaatagcatgttcctcattccccaatgacacctcaccagaatcacccttactattatttccagcttgcaaatcagaatttttccagcctctactcatttgtcagtttcaaagctgcttcacatttttagtttttttatttgtttgtttgtttttaattccagtgcctcacttctcagtgccaaaatctgccttaatcagctcaggcaaccataacagaataccacagaacaaatggcttacaaattcatttaattttaaataaatgaggtta

SEQ ID NO: 82991 - DNA, 980 bp, Homo sapiens
tgcccttcccccagcaggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcatggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtccccaaagccggcacgctcagttaccaccagcaacccttccaaattcactgcgaagtttggagagtccgagaagtgccctcgatgtggcaagtcagtctatgctgctgagaaggttatgggaggtggcaagccttggcacaagacctgtttccgctgtgccatctgtgggaagagtctggagtccacaaatgtcactgacaaagatggggaactttattgcaaagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggcaataaataaatgttttagtgctatcttgta

SEQ ID NO: 82992 - DNA, 811 bp, Homo sapiens
tgcccttcccccagcaggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcagtccccaaagccggcacgctcagttaccaccagcaacccttccaaattcactgcgaagtttggagagtccgagaagtgccctcgatgtggcaagtcagtctatgctgctgagaaggttatgggaggtggcaagccttggcacaagacctgtttccgctgtgccatctgtgggaagagtctggagtccacaaatgtcactgacaaagatggggaactttattgcaaagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggcaataaataaatgttttagtgctatcttgta

SEQ ID NO: 82993 - DNA, 541 bp, Homo sapiens
tgcccttcccccagcaggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcatggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtccccaaagccggcacgctcagttaccaccagcaacccttccaaattcactgcgaagtccccaagtgccccatttggcagaacatttattttctagaggtatgggggggcagcttcgacaaaactttt

SEQ ID NO: 82994 - DNA, 460 bp, Homo sapiens
tgcccttcccccagcaggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcatggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacacccaaagccggcacgctcagttacacagcacctcaatactcgagtttg

SEQ ID NO: 82995 - DNA, 1356 bp, Homo sapiens
tgcccttcccccagcaggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcatggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtccccaaagccggcacgctcagttaccaccagcaacccttccaaattcactgcgaagtttggagagtccgagaagtgccctcgatgtggcaagtcagtctatgctgctgagaaggttatgggaggtggcaagccttggcacaagacctgtttccgctgtgccatctgtgggaagagtctggagtccacaaatgtcactgacaaagatggggaactttattgcaaagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggcaataaataaatgttttagtgctatcttgtatggctctagatcttttctttgagatagaaattttcaaaaacataaagctagttcaaaaaacgagttgcagagcatataataaatttggatgtcaactgagaaaggagtgagaaggaagaaacaatgcgcaaaggaaagcagtctttcagaatctgtcagccaagtgtctttctagttactgctaatggagaagaaaacagggggtctgggagaaaatagagaacatgatagcaaaatctaaaaggaaaatcaaaactaataaaattgctgaagagttgatccctttgtcctatcgtggggctttgtaatgttacacatctcgtgaaaactcagaaatgacaataaagcgtggcatttgcctctgtattataaatga

SEQ ID NO: 82996 - DNA, 995 bp, Homo sapiens
tgcccttcccccagcaggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcatggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtccccaaagccggcacgctcagttaccaccagcaacccttccaaattcactgcgaagtttggagagtccgagaagtgccctcgatgtggcaagtcagtctatgctgctgagaaggttatgggaggtggcaagccttggcacaagacctgtttccgctgtgccatctgtgggaagagtctggagtccacaaatgtcactgacaaagatggggaactttattgcaaagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggctatggggggaaaggtatcgatcggtgcatgtggtgagcggggtac

SEQ ID NO: 82997 - DNA, 569 bp, Homo sapiens
aggggggaccccccaaaaaaaatccccccctcctttatttccccaaaaaaaaatttcaccttggagagtccgagaagtgccctcgatgtggcaagtcagtctatgctgctgagaaggttatgggaggtggcaagccttggcacaagacctgtttccgctgtgccatctgtgggaagagtctggagtccacaaatgtcactgacaaagatggggaactttattgcaaagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggcaataaataaatgttttagtgctatcttgta

SEQ ID NO: 82998 - DNA, 1088 bp, Homo sapiens
cactttgctttgcaggaagggaacaactgtgctgtgaataccaggatccaggagggagggagggtatatctgtgtcccccagctagggacaaggcttccttaaccttaggtcctcatgcttatattagttcttctccaacaaagtttgactttgagaagaagctggcacatggctgaaatgcactcacgcggttgggggaagagtgttcttccagtcctcctccccacagggcctcctgcttctcctaagtacctgtcatcaaaggagatgaagatgaatcccccttcagcccccacacctcaatgagttgtcaagtactctccctcccacttgaataggaagcaggagcagcaggccaggttgcaggttgaggaagtcagaagttaacttgagctgagtttgcagctctggagagattgaggagcagacttttctcttgtcactttggaaggagaggattgtgaggctgcccctttaaatagcattcccgtaggaggcagatcacatccatccgtcacctactgccaaagcatcatttttggtttctatcaaactcaaagcttgttggaaaggattgtggggttaggggagtgaggaggcagagcctcctaggggtagggggcagtttagaagctgaaaaggagaggaatgagaaggagcctgggaaaggtgggggatgaggacaagaggaaaagacagggagagaatagttgtcttttgagcctcagagtggaacaagtatacccaattcttatctgtttagagacgcagcaaggtagaaatgggattgtattgcaacaagaggaatgaggttgagactaaacaccaggactggtgactaaagaaagtgaaaggagccacagagtgaaaaaggctgatagacttggctctggttttatcacttactctctgtgagaccctataatttttctgggttagtttagttctcatttatttttatttttactttttccatcaaactgtgttgtctatgaagttttcccatttattaaatgaagggaattagagtggatgaactctaatgtctctttcacgaataactttgtgtgtgtgtgcgtgtgtgtgt

SEQ ID NO: 82999 - DNA, 714 bp, Homo sapiens
ccccagtaggatccagtctgtggggcaagccaggcatttgagggagaatgagcacggggcttttggaggctgcagcctagggccaagggatggaggctcacctgagtgcaggttaggcagctgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccaggatgggaccagcgactgagagagccagaggcagagaggtgagggtgaccatatcctggactgtgagaggaatgggactctgggcctgtagctgccaagcaggtggcaggtgctccaggctgtgatctgcaccctctgacccctgacattgacctcctaccctgacccctgcctgaccaagccatgtctgaacaggaggctcaagccccaggggccgggggctgcccccggacatgctggcagagcaggtggagctgtggtggtcccagcagccgcggcgctcggcgctctgcttcgtcgtggccgtgggcctcgtggcaggctgtggccgcgggcggcgtggcactgctgtcaaccaccagcagccgctcaggtgaatggcggtagc

SEQ ID NO: 83000 - DNA, 374 bp, Homo sapiens
aaaaaattgattaacatgcagtattaaatctttaaaacaagagcagccctctccctctccctctccctctcccccctctccctctccccacggtctccctctccctctctttccaaggtctccctctgatgccgagccgaagctggactgtactgctgccatctcggctcgctgcagcctccctgcctgattctcctgcctcagcctgccgagtgcctgcgattgcaggcgcacgccgccacgcctggctgtttttcgtatttttttggtggagatggggtttcgctgtgttggccgggctggtctccagctcctaaccgcgagtgatccgccagcctcggcctcccgaggtgccgggattgcagatggagtct

SEQ ID NO: 83001 - DNA, 738 bp, Homo sapiens
cccacttgagatgggcatgtcaccatcactcctgcgtgagcttcagagagccaggtcacctctactcagttctaacatctgctccagggtttcaattccatcctgttgctcttcttgcccagggccagaggccaagatggattcctgactagctgacagctgtgcctaccccatagggctctcggagctaatcctacaaagtgcttgcactggataaagttggttgagtcacaccttgccctctccacatggagcctaggtttgcctaaatgggcagcaaggtataatgagaagaacagagggttcggaaccagaatgacacaggttcaaatcccagctctatcccttagaactgtcccaccaaggaagatccactgctgctgagctctagtgaacccctctgtaaaatgagatgaggactcctgctcaggatgttgtgaggacaaaaggagacagcacgcacgtaaagcacagtcccagtgcctataagcaccgattcctttctggtgaatcaggcgtgaggaaaggctctacccgagatgccctcgtcccaggcacctttcaggctgtacccacgctctcacccaatgagggtggtgatggctccccaacatcatttcaagctctaggctgtactaggcctctgcggatgcctggaggtggctcttgtcaattctcacctcccttcctgctgctgcccggctcgtcaggaggccgcttgaaggctgggctgtggtg

SEQ ID NO: 83002 - DNA, 451 bp, Homo sapiens
attttagggaaccacagtatctgatagcttaaaagtaatgaaaagccatttactgttatgtgttgctataaaatctactgtttgtccagatgcctaaactgagttgctttgtgtagtaaacacactgatggtcacaccttgagatcatgaggtaaagtctttgtagaaggtgctggcaacttagtttatcctacctcagaaaacggaatctgcctgctttggggactcgcagaacacaggaagcctgggtttgttgttggtctcatctctcacatgatttcagcctcgtcgttcatgctacctctttccacacaccttctctgcagaggagatggacgttgcggttcaggcttttcagtccgagtgggttagtgtgtgtgagagtttcttaaggaaaacaaccctagcatgtgagaaagggcaggattccaacaaagctctctgcctagcg

SEQ ID NO: 83003 - DNA, 179 bp, Homo sapiens
attttagggaaccacagtatctgatagcttaaaagtaatgaaaagccatttactgttatgtgttgctataaaatctactgtttgtccagatgcctaaactgagttgccagcaccttctacaaagactttacctcatgatctcaaggtgtgaccatcagtgtgtttactacacaaagcaa

SEQ ID NO: 83004 - DNA, 565 bp, Homo sapiens
gaggccttgctaatgagaactagtacggctttcaaagctctgacctcacatatctaatagggcaagcaaaatggaaagacagcgtatacttgggggcagtgagtgggcctcaaagaagtggcaaaggcagggccctcaggctggggtgttgaggaagtcctagatgacaatcgtataatacattcatataaagacagagcaatagcaacatgtcctcagccttacaaaaggaacttaaacgtgaaattttcttccaaattatgtggtggcaaggtcagtaaattgctttatttttaagatgtaaaattaaaataaccatttcccgatctcctacttcctcccctccccaaaaaacaacctattttaggtaaaggaaataattcaacaaaaatatacagaaactatttaaacgtgcagagaaaagataagaactgctgctacgaaagagagcaagagatggagaggagaacgtgtgatagggctggctactgagaataggcaagaaaaagaataatttagatgagaatatgtatgaggatatataaatggcaaaatggatacagta

SEQ ID NO: 83005 - DNA, 190 bp, Homo sapiens
tgatctagaggatctcgttactggcatttctatttggtgtacgcattggttttaactaaccgtttctagtgcatttaatactgcattttcagagcagacaacagtttcagtctcagtaaacatgattttgttagtgtcattttttatttatttttattttactttatttttttgagacagggtctttctg

SEQ ID NO: 83006 - DNA, 509 bp, Homo sapiens
ctaaaaatagaatgtaggaaaaaaaaatagaacgtaggcatcttgatattaaattccaaataagaaaccagcaaaactcatcttcccccttctcatgattgtgtatcttccacgggtatggaattgtgtggggtgttattgaggctgtgtggtgtgctggcgtctgaatgcagcttgacataacagaaagcagttgctccctgcgttcttatttctacaatatacagagacttttctgtcctgtagatacatgggggatgatcataagtgagcttttataagcgcagagtattacctatatcaccgtgaaagtgtatcgcatacaggacagttttggcttattaagttaaattaaaagtgaattccttttaaatgacctgcttaacggctttcctcctccaccagttactattaccttttcattctattacaggtggaaatgacatttttagggtcttccattatgtgtctaagccaccttctgacattcttagtagatggcttttttc

SEQ ID NO: 83007 - DNA, 755 bp, Homo sapiens
gccattctgaccttgttgatgcttacaattatttaaaatccctggcttctggcagttaaatgccacaactggcctctgtttttccagggttctatcaacttctttgttaccaatgagtcaggttctgtaatggcctctcctacagtgacctctggcctaaagaggagcatcactactctgcttgttagtgttgctagtgcttctttcaccagctcattcattacagccttggtaaactgtgtatcctttgggccttcccatggaacatattcctctcagtcttccagccttatttgtattttcattccagcatgcttattttcctcagcctttcccttcctcaaccttcttccatggcaatcccagcatttcaactttgcttattattaaccatctatcttagtgggcatataaccatctttgaagttcagctactctgactataaagtctagtcttggtcttcacctttctccagcctcctcctgcaggaaatgagagcttcttttttatgcagccaaagaggccctctgacaatctcacttggtttttaattgcttgttattcgctctgattttttcattatctttgtgtagagcatcaataccgcttagcaatagccatccaattcctttatctttatcgctactttattccccatacatctcaaatatatctgattcatctggccagttcacaaacagtgaaaatgttaataatttgattactaccttgtgataatagctgtttgtgctcc

SEQ ID NO: 83008 - DNA, 424 bp, Homo sapiens
actactttggtgctggataaagccccacataccctgctaaggtgagaagctagctgatacagggataagtgacaagcccagaaacgtggtcagtgaatgaagagttttagatagtgccagtgcaccagtgagtgaaacagtctgtgatccatcagaggataagtaatggtcagtgtgccaaggtgttgaggcaacttattgctgctgctgctgctactagacctagaaaactttacatctggctcacttagatactgctaagaatcaaagtaaaagtctttacattaaagtgccttgtctagtgaatttccattatgcagggtcctctttagttcagttaaacatccctcaggcagacagaaagaaatagaacactaaaaaattcatttttgtacttcttagcatatttaagcatcattgcatg

SEQ ID NO: 83009 - DNA, 378 bp, Homo sapiens
aaacaaaagcaactataataacaagcctccccattttaaagacaaagtttactactgtatttggttaaatgaatgatgggaatttttcttctttgttaaaaatgttttggcttataaatgtagtacttcacagagttgtagttctgcaagagaacttttaaaaagtgggcaaagacctttcagtacattaagtacaaatgtttgttagttcttgattgtaactactctggcataatcaaataacccacatttttaaatggaaaaactgtagtatgtttatttaatgccaataagcaaaagtgacagccttacatttgcttatcaagataaatttcttcaagtaaaattttttataataaaggtatctcctcagataaa

SEQ ID NO: 83010 - DNA, 369 bp, Homo sapiens
gttctagctataaggaattgagttatatgaaatgtgctgtgcaagattatataatttgtaacttttttctttttattctgacatgggaatttaaaaattatgttttgctttggctaataataaaatcagcctgcattcacatctgcttattctttgctaatatacaggctgatggcttgagcaggattctttgataaatggaaaaaggcaaacagtatgaaattaaaaattagccatcagtgtaaaccaggaagtggctaatctacacattttagatttgacttcatttggccagttcaactttaaaaggcactatgcctcaaacttattttctctgaacactgttttaatcttgtacagtctcttaag

SEQ ID NO: 83011 - DNA, 408 bp, Homo sapiens
ttgtcatgtttaaagatacagagtcactattttagaagtgaagggataggggtctcaaaacaaattgaaatatattttgtgaaatatatacatatgtattccacttaaatataaaatatatagtaccaatatatatccttgatgcttattaaatactgatctatatccttggactttttaaaaaaagtacagtcatgtatcgcttaacaacaggggtatgttctgagaaatgagtcatgggatttcatcattgtgcaaacattgtagagtgtacaacacaaacatagacggtgtgtagcctactacacacctaggctgtatggcataacctgttgctcctggaccacaaacttgtatagcatgttatggtaatgaatactgtaggcatttataacacgatggtatttg

SEQ ID NO: 83012 - DNA, 828 bp, Homo sapiens
gcccgtttcagccctgaactgaccaggatgacccgcctacgcggccgtttcagccctgaactgacgaggatgccccgcctacgcggcccatttcagccctgaactgaccaggatgacccacctacgcgggcggcccgtttcagccctgaactgacgaggatgccccgcctgccccgcatatttcaaccctgaactgaccaggatgccccgcctactcggcccgtttcagccctgaactgaccaggaggccccgcctgcctgaactgtttcagtcctgaactgcctggactgtttcagccctgaactgaccaggacgcaccgcctgcctggactgtttcagtcctgattgatgcctgtgcagctttgggaggcatgaccgcacctcctcctccctacacaccccagtgggggaagaggagagaaaatacgcctcttccctggctcttcactggagtcttagtgatttggtggagatttccaaggacaggcctccgggagctcagcgccgccctcctgttactgggcagttaggtgtgggaaggaacatactgacaacccatttttcttcaggaaaatcccattcaccacccttgaccttatattgctcagcccaggggtgtacatgggggaagtggtagtcacagggacagtaaggcaagcccagtctgtgtctaatgactatttcttcttcagatagttgagaatttaaatgtgaatgcaaatgttacgcaaatgaaattactcctaagacaatttacacagaccaactattaggatcagaacctcctgtttaacacagcctgcccaaaataactgagactattccga

SEQ ID NO: 83013 - DNA, 719 bp, Homo sapiens
aggtgcccaggtctcaggaagagggtggtagggcccaggctcccgtccggagagaagccgttaaaatccaccaccctccagcttcaatctagtgacttttaaatttctatattcaaatcaggcctctctctcggggcatgtgtgtggcggagagtgtgagggctgccttccgagtgataaaaaagagatttaataacattgttcaaatgtgggaaaatgacactgcgccgtccttgtgagaagacaggactgcccgagccaccgctcagctctgctcagaactcctgggcctgagataacattgatttgggcgcttgcatcacacatgtgccacatgacggattgctggacgttgacagcatggctccgctactaaaaacatatgactccatatggaacgccgtggtgtggggtggaaatcctggacggctccaggctgcagatggccatgtataattcacgggatttgtaagactctgcatctgctccgttgctcattcttcagttgtcagacagacataatcccgagcctcttattttataacacagatctgccaacgggagtggggaggggagccggggaggcagagccgctgccaggagaactcagaaataatttggggagaacattcggcatgtcagcgaggacagaagcgcgcaccgcaggaagcccaggcaaagttggaaacagggctgccggttccctggtccctccctgg

SEQ ID NO: 83014 - DNA, 388 bp, Homo sapiens
tatagatgtagttcttgagctttggcctctctgtcctaaggcatggcttctgcatagaattacaccagaactcccatcttttatcattgacttctggttcagcctcctgtagtaacttacctccccttataagcagcgggacattatcaggatggatggagggaggtgagcctggtaatatgatccctgctgccatttcagcgatgctggcctcagctgggtgatgtaatcttgtagttgttctgcatcttgtgacgtgtaaaatccataagagccctggaatcactgtagtcgtcttatcttagttccaaggatctcaactccagtgttcagcaaatctcaaggttgcagaaattgtaagagtacagtctaactatgtgccaccaac

SEQ ID NO: 83015 - DNA, 293 bp, Homo sapiens
agtgtggcttctgggggctaaaatcaagcaactcgtgggaaagcagagtatcatcgcaggacaaggcgtgtgtcctggtacacgggctgggagcatctttacagatgagccaaccaggaggatgttctcaggtaccagtggcacctgccaagaagtctgctctgtttctctctggtttggaacagacccatgctcctcacccctggcacattggtgttggtgccttgcagaatctgctttgccatcttgtgaggggcaaacggagcagatggccctgaccactgggatgccag

SEQ ID NO: 83016 - DNA, 956 bp, Homo sapiens
gttcaagcgattctcctgcctcagcttcctgagtagctgggattacaggcacgcaccaccacacccagctggtttttgtatttttagtagggacggggtttcaccatgttggccagcatggtcttggtctcctgacctcatgatccgcccaccttggcctcccaaagtgctgagattacaggcgtgagccaccacgcccagccgacaagtgagtttcaactgcccaaacgtcagggcacattattgcaagattaatgaaatgactcaagcaggcctccagggctggctggcttggggtaaattgtgctgcttcaacctgtccttgtcctggctgtggtttggcaccacctagtggcggttgggtgctctagcttaaatgtcaataaggaggattctggatcctgctcttgattggaactttcaggacagtggcagtgattccaggaattttcaggttagttggcgtctgtttcattggccaaatctggggtgattcagcctggagaataccttttctgcctccctgcttctcagcaccaggttgcttgctgtttcctacctggcctcagcctcctctcagcaaccccctttctccaaagatacaaactttagcctgtctccaagtggaaggttacctatcaagttacatctaaatgcctgtcatcacaaggagtttttacggagctgttcatgacacttaagtgagacatgaggcaagtaaaaggcccagtacctagaaagtgtttgaatgaaaattcccttttccggccagatatggtaactcacacctgtaatctcaacgctttgggaggccaaggcgggaggattgctgagaccaggagttcgaggctgcagtgagctatgattgtaccactgcactccagcctgggcaacagagcaagacgctgtctcaaaaaaaaaaaaaaaaaaggaaaaagaaagaaaggcctgtccca

SEQ ID NO: 83017 - DNA, 389 bp, Homo sapiens
agcaggtgaattatttcctaatatgaaaactttacatttggactcaggatttattttagtactatgatcttccttctcttttccttccaataaaagggatgctttcctcaagttgagcctcagtgaagagattataatgtatatatatttgatacatatatttaggggcagggtatcactttgtcacccaggctggagtacagtggcacaatcatagcttgctgcaccctcgaactccacttccagagtggctggactacaggtgtgtgccaccatgcctggctaatcttttcaattatttgtagagccaggatctcactatgtttcccaggctggtcttgaactcctggactcaagtgatcctactgcctctgccttccaaagttctg

SEQ ID NO: 83018 - DNA, 368 bp, Homo sapiens
gtttttaacaattgatatttacatatattaactttatctttcttcacccacctacagtattactaacttgccttacatcttttttatttatgttttgtcttaaaagtgacaaagattaaaagatattcttcataacctacagaaatgtacacaatcacattttattcaaatagaaaattctatgatatatgaatattctttatataatttccaaaatatctttgccattcttcatgacatcacataacatcacatgaagttactaaaaaaacaaacaggacatatttcattcatttcctcattaccacctccttcacaccacagtactcctcatttttaacagccaatgctaaacattcccaagagtg

SEQ ID NO: 83019 - DNA, 686 bp, Homo sapiens
tttccctaaaaagtttggtctcatctccctcaaaacgatttcagtcttcttcactctcctcaaacctctaaactctctggtagaaactgcattcttaatacattaaatgtcttgatatggaaacttcctcattttcccatcactaaatcttcaagtttatcttcatttgtattgtccattatttctgtgatcctgtctattcctggcttctgaagcacttgacccattcagttattcttcccttcctgagtcttcaacctctccttctatgccagatcctattcttcaacattcacagattctccagcatctcccatgtctcccattttatacaaagtacagcctttaattccatctcttcttgtagtaaatgccttagtatcctctagctaccaacaacccctttttttttttttttttgagatggagtttcactcttgttgcccacgctagagtgcaatagtgggatctcagctcactgcagcctctacctcctgggttcaaacgattctcctattcatcctcccgaatagttggaattacagacacccgctaccacgcctggctaatttttgtatttttagtagagacagggttttgccatgttggccaggctggtctcaaactcctgacttcaggcgatccgcctgccttggcctctcaaagtgctgggattataggcgtga

SEQ ID NO: 83020 - DNA, 434 bp, Homo sapiens
agagcacccaacactgtcctacagagcctagaaattaaactttctcagaagacaagggctgacgagagggtacatagtattaagaaattgaatatactctctgtatctcttgttagtacccaggtgaaacataggagacaaaacacatattacagaggtgtctcattttacacagtgggtatatttccaaaaagttgttgaagcaacctttttttaaatcaaattattttcccattgagtaaaactatgattcaggatatgaattttcttagttgctcgttagtcttcatttgccggaactcttaaatgggggtaaggtcctcagttcctgagggtctctaacaaagtgaatataaagtattgaaaacaaatactgaaaagatttctgtagatgatttttttggcaatgtgtctaacagtcttctctgattgta

SEQ ID NO: 83021 - DNA, 469 bp, Homo sapiens
cccagaacatgtctttctcggtaggaagaagtttagcagaggattatggagatggtctcagcaacaagactgcctggatttccatcctagttcctgccccaggtggcttaacctctctgcagttccgtttcttcacctgtaaaatagggataagaattctgttggaagaattaaataagctaagaagtatggagtacttggaacaaggtaccaggtggatacttgagtgctaagctggttgtccttgggcccttcatgccaggctcccagaggccctgcactctgaacatcaggcaatgcctctctatgatacatagctttaatcagcagcaaaataaaatggggctcattgaataaggcttacaaagatgatgagctcctgcctgggtttgcactgcctgctgtgcggacgagccgcatctgtggactcctccttagtcagaccaagctgccatctttaccttggctc

SEQ ID NO: 83022 - DNA, 1666 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaa

SEQ ID NO: 83023 - DNA, 2230 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaaaaaaaaaaaaaaaaaaaaaaaaaaaaaaaaaaaaaaaaaaaaaaaaaaaaaaaaaaaaaaagaaaaaacaaaaaaaaaaacaaagaaataaagaacaagaaaaaaacaaaaaaaaaaaagaacaggagggggcgcggcggccaactagatactaaatcctcgcccacgaggaggccacccataataaccgcccacgcacgtttttttgttagagaaaagagcggcgcaccaaaaaaacgaggaggtaattaaataattcaaccacgcggaggggcgccagatcaaaacaaaacacagccagggtgggaagaaacaacaacgactcgtcgagaccgagcacctcttgaagaaaaacaccacacccacatggcggggcgaggaacaaataacatgcggacacaaccacaccccgacaaaagtaaacacacacccaccagggaacccaacaaacacaaaatagacagcggcgtagaaggggagacacaccaaaaccgacgatctaaagagggcagggaaaaacagaatcgtagctacgacgaatgacctaaaacaaaaaaaaaaacg

SEQ ID NO: 83024 - DNA, 1530 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattga

SEQ ID NO: 83025 - DNA, 2172 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaatgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaaaaaaaaaaaaaaaaaaaaaaaaaaaaaaaaaaaaaaaaaaaaaaaaaaaaaaaaaaaaaaagaaaaaacaaaaaaaaaaacaaagaaataaagaacaagaaaaaaacaaaaaaaaaaaagaacaggagggggcgcggcggccaactagatactaaatcctcgcccacgaggaggccacccataataaccgcccacgcacgtttttttgttagagaaaagagcggcgcaccaaaaaaacgaggaggtaattaaataattcaaccacgcggaggggcgccagatcaaaacaaaacacagccagggtgggaagaaacaacaacgactcgtcgagaccgagcacctcttgaagaaaaacaccacacccacatggcggggcgaggaacaaataacatgcggacacaaccacaccccgacaaaagtaaacacacacccaccagggaacccaacaaacacaaaatagacagcggcgtagaaggggagacacaccaaaaccgacgatctaaagagggcagggaaaaacagaatcgtagctacgacgaatgacctaaaacaaaaaaaaaaacg

SEQ ID NO: 83026 - DNA, 1619 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaa

SEQ ID NO: 83027 - DNA, 1449 bp, Homo sapiens
atctttgagtgtttggttaaatgttcaaactgtggcttcctcccggcgccagtcgcccgcctctgcccttaggttacattctcttaaacatgcctttctcccccactctttcgcaggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaaaaaaaaaaaaaaaaaaaaaaaaaaaaaaaaaaaaaaaaaaaaaaaaaaaaaaaaaaaaaaagaaaaaacaaaaaaaaaaacaaagaaataaagaacaagaaaaaaacaaaaaaaaaaaagaacaggagggggcgcggcggccaactagatactaaatcctcgcccacgaggaggccacccataataaccgcccacgcacgtttttttgttagagaaaagagcggcgcaccaaaaaaacgaggaggtaattaaataattcaaccacgcggaggggcgccagatcaaaacaaaacacagccagggtgggaagaaacaacaacgactcgtcgagaccgagcacctcttgaagaaaaacaccacacccacatggcggggcgaggaacaaataacatgcggacacaaccacaccccgacaaaagtaaacacacacccaccagggaacccaacaaacacaaaatagacagcggcgtagaaggggagacacaccaaaaccgacgatctaaagagggcagggaaaaacagaatcgtagctacgacgaatgacctaaaacaaaaaaaaaaacg

SEQ ID NO: 83028 - DNA, 1545 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgagtgtttgcttgtgccacccgtgggtaaactgcccctcggtgtgtgtgcgcgcgcgcgcatgtgtttttgcttgtgtatctataaaatgtctgatttggtaaatgcatgcttacttcgcggtgttacccgtactacattgtctcactagacatgaaggagcttgtagctttgggtgctcgagatcacagaacattttcctttaaaaggaaatgatgccaataacttactacgaaggcggccgaggaacgtgtgtattggctttgtagcaaatgtaatgccctggatcttcctacgagtcctctggtactatgaggtactaacctccactgtaattaatcttaccgccacaaattccatagtgatcctccttccctaaaactatagtcctctgggattctctgggctagttgaggattgctaccctgtgccttcaaccctgtgatgtgggatcccagacttccctatctgttaactaaagggctgttttcaatcaaataattgttacgagaagcagactggcgcctgtagcactgctgttggagatccaaataggagattgggttgggaagtttttcccttgagtctctgctattttaatgtttaatttgcgctgtcgaggcgagtgtgtgtgttgcatctggacg

SEQ ID NO: 83029 - DNA, 1333 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggtaagacctgctccggggtccccgccccgccgccgcacactcccgcggtcgtctgggctgtcactaggagatccgtagcccagacggtgactttcgtatgagctatttaactttattttcttcagaatctggatctggtctccttgcaaacccacttgcttcatgtctgtctttacgccttttttccctttcttctatttccttttgtctttccagctcccgctgtctctgtcgttcctctctttggcgcttcactactttctcataatcattaggaaacattagggtcatattcgtcagctaagggaatcagaacttcccctgcagaaaacccactgggaacaggatccttcagcccagctgctacatgcggtggagtgtccacaatttgccggtcatctgaggaaccacctcgcttcaggtcaatgactggggcgaggactgtacatttgtttcgtcctttggctcaattgcctgagtgagagctccttcttcacctg

SEQ ID NO: 83030 - DNA, 284 bp, Homo sapiens
gtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaagaagtcaatacctgaattccgag

SEQ ID NO: 83031 - DNA, 1658 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcattataagcgtgtagtataatctggagccagggggagcggt

SEQ ID NO: 83032 - DNA, 1613 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaa

SEQ ID NO: 83033 - DNA, 2559 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggtaagacctgctccggggtccccgccccgccgccgcacactcccgcggtcgtctgggctgtcactaggagatccgtagcccagacggtgactttcgtatgagctatttaactttattttcttcagaatctgctgtagattgagctgtgcgtgaaattgctagtaagttctgacatgttaatgcgtctgtctttaaatctgaattgttaccataaacgtgtttaatggaacttgctggtctgtggactacaaaaaaaaaaaaaaaaaaacaaaaaccctttctacttaacattgtcttaacctcgtactctttatcctctttctttccaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaaaaaaaaaaaaaaaaaaaaaaaaaaaaaaaaaaaaaaaaaaaaaaaaaaaaaaaaaaaaaaagaaaaaacaaaaaaaaaaacaaagaaataaagaacaagaaaaaaacaaaaaaaaaaaagaacaggagggggcgcggcggccaactagatactaaatcctcgcccacgaggaggccacccataataaccgcccacgcacgtttttttgttagagaaaagagcggcgcaccaaaaaaacgaggaggtaattaaataattcaaccacgcggaggggcgccagatcaaaacaaaacacagccagggtgggaagaaacaacaacgactcgtcgagaccgagcacctcttgaagaaaaacaccacacccacatggcggggcgaggaacaaataacatgcggacacaaccacaccccgacaaaagtaaacacacacccaccagggaacccaacaaacacaaaatagacagcggcgtagaaggggagacacaccaaaaccgacgatctaaagagggcagggaaaaacagaatcgtagctacgacgaatgacctaaaacaaaaaaaaaaacg

SEQ ID NO: 83034 - DNA, 1612 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagctccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaa

SEQ ID NO: 83035 - DNA, 1172 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaattatttatgcccaaataatttaccctgcagtccatgagtgtagaaattgaa

SEQ ID NO: 83036 - DNA, 1024 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaacttgtcctccttgtgaaatggttgaaaagtcgacgcggccgcg

SEQ ID NO: 83037 - DNA, 1874 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggtaagacctgctccggggtccccgccccgccgccgcacactcccgcggtcgtctgggctgtcactaggagatccgtagcccagacggtgactttcgtatgagctatttaactttattttcttcagaatctgctgtagattgagctgtgcgtgaaattgctagtaagttctgacatgttaatgcgtctgtctttaaatctgaattgttaccataaacgtgtttaatggaacttgctggtctgtggactacaaaaaaaaaaaaaaaaaaacaaaaaccctttctacttaacattgtcttaacctcgtactctttatcctctttctttccaggcttctgaattcccttctgagttaatgtcaaatgacagcaaagcactgtgtggctgaataagcggtgagtgtttgcttgtgccacccgtgggtaaactgcccctcggtgtgtgtgcgcgcgcgcgcatgtgtttttgcttgtgtatctataaaatgtctgatttggtaaatgcatgcttacttcgcggtgttacccgtactacattgtctcactagacatgaaggagcttgtagctttgggtgctcgagatcacagaacattttcctttaaaaggaaatgatgccaataacttactacgaaggcggccgaggaacgtgtgtattggctttgtagcaaatgtaatgccctggatcttcctacgagtcctctggtactatgaggtactaacctccactgtaattaatcttaccgccacaaattccatagtgatcctccttccctaaaactatagtcctctgggattctctgggctagttgaggattgctaccctgtgccttcaaccctgtgatgtgggatcccagacttccctatctgttaactaaagggctgttttcaatcaaataattgttacgagaagcagactggcgcctgtagcactgctgttggagatccaaataggagattgggttgggaagtttttcccttgagtctctgctattttaatgtttaatttgcgctgtcgaggcgagtgtgtgtgttgcatctggacg

SEQ ID NO: 83038 - DNA, 1820 bp, Homo sapiens
gcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagcatgtcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggtaagacctgctccggggtccccgccccgccgccgcacactcccgcggtcgtctgggctgtcactaggagatccgtagcccagacggtgactttcgtatgagctatttaactttattttcttcagaatctgctgtagattgagctgtgcgtgaaattgctagtaagttctgacatgttaatgcgtctgtctttaaatctgaattgttaccataaacgtgtttaatggaacttgctggtctgtggactacaaaaaaaaaaaaaaaaaaacaaaaaccctttctacttaacattgtcttaacctcgtactctttatcctctttctttccaggcttctgaattcccttctgagttaatgtcaaatgacagcaaagcactgtgtggctgaataagcggtgagtgtttgcttgtgccacccgtgggtaaactgcccctcggtgtgtgtgcgcgcgcgcgcatgtgtttttgcttgtgtatctataaaatgtctgatttggtaaatgcatgcttacttcgcggtgttacccgtactacattgtctcactagacatgaaggagcttgtagctttgggtgctcgagatcacagaacattttcctttaaaaggaaatgatgccaataacttactacgaaggcggccgaggaacgtgtgtattggctttgtagcaaatgtaatgccctggatcttcctacgagtcctctggtactatgaggtactaacctccactgtaattaatcttaccgccacaaattccatagtgatcctccttccctcttcaaccctgtgatgtgggatcccagacttccctatctgttaactaaagggctgttttcaatcaaataattgttacgagaagcagactggcgcctgtagcactgctgttggagatccaaataggagattgggttgggaagtttttcccttgagtctctgctattttaatgtttaatttgcgctgtcgaggcgagtgtgtgtgttgcatctggacg

SEQ ID NO: 83039 - DNA, 2105 bp, Homo sapiens
  misc_feature (1197)..(1197): n is a, c, g, or t
  misc_feature (1199)..(1200): n is a, c, g, or t
gcgagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcctacagaaatattacagagttgaaaactctgaaggggttggcactgcatgatatcctgacagagatacacttgtttgtgcatagagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctagatgctctgagggccattcacaattctcagggctcagcagtgatgggngnncagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttactttaaaaactggtctttttatttaccctctgtggtagaagagtcaccagcaggttccaaattgatgtgtatgataggaaaaaaaccttaattttaaatataatatagagccttaaactatgccactgggtggcagaggctgtataaaacgcacttgttttcatgcaggagcggggcaagtaaggttgagcctgactgtaaacctagaactgcggaaggactgggacttttgtacaaatttcacatttattttacagcaatcatgctgcatttgtgttagtgttctttataataaaaaacaaagcagcctcctggctggctgtgttacaagtgactcttccttagacagctagaaagatgctgactttgtcaaacttgcatttatatgaaaaccttctgtctctaatatcacagaataaactttctttagatgctgttcttt

SEQ ID NO: 83040 - DNA, 711 bp, Homo sapiens
gcgagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctggtaggaggaggccgagcggcggcggtgggcagagggggccaggcggccgcgcggggaggaggtggctggggtggcaggtgaccggaccccaacccgacctcttcccgtcgtctccaggcctgcagccgggaccgacctgcagaggtttcccccgacaccccccagctacccagactcgtccgttctgtttagggcttttgccagttctcaccctttcacccccagctccatttgccgaagaagaaggcggctttcgcacctggtgacagcacaggggttcgatcccgcgtctcctgacgcctgcaatggcctccatgccaaaatgccctcttcccactcttcaaaacctgcgatgcgactattggtcacattttaaactagtaataacgctccctggtcaacttttattgaatggcatattattagattagcagacgccctgttagatgttcgatccttacaaagaccgtaggaggtaggcaccgcttcaaattttacacaggaggaaactgcatttta

SEQ ID NO: 83041 - DNA, 947 bp, Homo sapiens
  misc_feature (938)..(938): n is a, c, g, or t
gcgagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcagtcctgccaggatgacagagctagnctctgtcta

SEQ ID NO: 83042 - DNA, 1311 bp, Homo sapiens
  misc_feature (1302)..(1302): n is a, c, g, or t
gcgagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgagacagggtctcgctctgtcgcccatgctggagcgcagtggtgtgatcacagctcagtgtaacctcaaacattggggttcaagccattctcctgcctcagcctccgaagaactgggacttttagaggcgagctaccaagcccatcctgtaaccattttaaaatgtacaattcagtggcattaagtacattcagaatgcagtgtactgttgtggagtcttcccgctatctagttccaaaatttcatcaccccaaatggaaatcctgtacccattgacagttactccccattctccccttcctctagcccctggcaaccactaatctgctttctatctatggatttgcctattctggacatttcatggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcagtcctgccaggatgacagagctagnctctgtcta

SEQ ID NO: 83043 - DNA, 2166 bp, Homo sapiens
  misc_feature (264)..(264): n is a, c, g, or t
  misc_feature (1258)..(1258): n is a, c, g, or t
  misc_feature (1260)..(1261): n is a, c, g, or t
gcgagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgggttgaaaaataccggccacagaccctgaatgatctcatttctcatcaggacattctgagtaccactgaagntaccccaattcaaggaaagactttaatccaaattggaaaggaccccggacttgggcccaacaacctttggccttttccttccttaccggggttccccccccaaaggggggtaaccaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcctacagaaatattacagagttgaaaactctgaaggggttggcactgcatgatatcctgacagagatacacttgtttgtgcatagagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctagatgctctgagggccattcacaattctcagggctcagcagtgatgggngnncagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttactttaaaaactggtctttttatttaccctctgtggtagaagagtcaccagcaggttccaaattgatgtgtatgataggaaaaaaaccttaattttaaatataatatagagccttaaactatgccactgggtggcagaggctgtataaaacgcacttgttttcatgcaggagcggggcaagtaaggttgagcctgactgtaaacctagaactgcggaaggactgggacttttgtacaaatttcacatttattttacagcaatcatgctgcatttgtgttagtgttctttataataaaaaacaaagcagcctcctggctggctgtgttacaagtgactcttccttagacagctagaaagatgctgactttgtcaaacttgcatttatatgaaaaccttctgtctctaatatcacagaataaactttctttagatgctgttcttt

SEQ ID NO: 83044 - DNA, 586 bp, Homo sapiens
gcagtgtactgttgtggagtcttcccgctatctagttccaaaatttcatcaccccaaatggaaatcctgtacccattgacagttactccccattctccccttcctctagcccctggcaaccactaatctgctttctatctatggatttgcctattctggacatttcatgtaagtggaatcctacactatgtggccttttgtgtctggtttctttcactcaggatcatgttttcaaggttcatgcatgttgctgcttgtatcagtagttaatttcttgttatggctgaatcatattccattgtatggacagaagagattttacctatccattcttctgttgaagtctatttgggtaggagttcagtttcaaatgcactttgcaatagtaggtgcccatcaggttgagattataggcaaacagctggaaagatgaagttagaacagagttttcaacctcagcactattgacattttgggccagatactctgggtgggtttaggggagctgtcctgtgcactgtagcatgtttaacagcattcctggagactacacactgagtgccataggaccctctgcccacctgtg

SEQ ID NO: 83045 - DNA, 1977 bp, Homo sapiens
  misc_feature (1197)..(1197): n is a, c, g, or t
  misc_feature (1199)..(1200): n is a, c, g, or t
gcgagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcctacagaaatattacagagttgaaaactctgaaggggttggcactgcatgatatcctgacagagatacacttgtttgtgcatagagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctagatgctctgagggccattcacaattctcagggctcagcagtgatgggngnncagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttactttaaaaactggtctttttatttaccctctgtggtagaagagtcaccagcaggttccaaattgatgtgtatgataggaaaaaaaccttaattttaaatataatatagagccttaaactatgccactgggtggcagaggctgtataaaacgcacttgttttcatgcaggagcggggcaagtaaggttgagcctgactgtaaacctagaactgcggaaggactgggacttttgtacaaatttcacatttattttacagcaatcatgctgcatttgtgttagtgttctttataataaaaaacaaagcagcctcctg

SEQ ID NO: 83046 - DNA, 1073 bp, Homo sapiens
  misc_feature (1064)..(1064): n is a, c, g, or t
gcgagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgagacagggtctcgctctgtcgcccatgctggagcgcagtggtgtgatcacagctcagtgtaacctcaaacattggggttcaagccattctcctgcctcagcctccgaagaactgggacttttagagggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcagtcctgccaggatgacagagctagnctctgtcta

SEQ ID NO: 83047 - DNA, 577 bp, Homo sapiens
tgctgaggtactctagagtgatccccgttcctccccgttggagaaggcaggcaagggctccccgagcccaggaaactgcatctagaggtggaggattgagaattgtggctggaggttcggtcgctgccgggaggaggactctgtcgctggagctgaggctggaaaagtaggttgggatcaggttgtgaactggcccggtaggaggcctaggatatgattagcgctcacttctgcagggttcatccgctcactacgtcactcctggccgtgaggcctgtgtggtgactgcttgtttagagatgggaagattgaggtgcctcctttttctcctcatccctgccccagggtcctagcctaggatttttggaaattgaatctttgcttgcctagtgagacagcagaacttcatccccttcctaagccagtagtgaggcaaagcaaggcttcatcgccacgacagggagcccactgtgggatattggggcaatagttgagccttgtggagttggaaaggtggaggaatttagttaataaacagttattggtggacattctcacaaactcctactgtggagga

SEQ ID NO: 83048 - DNA, 2731 bp, Homo sapiens
gcacgctaagctagccacacttccggcaagagcagctagaatcgttccggtgcatattgaataggcgcagaaagggagaaaaagattctacagccctggccacagtactttggtgacacttttcgtggggctctctggaggacttttcccaaggcagatggagaaaacttcgtgaaacccactccttgctattaaaggaaatgttgtggaatataattggacttaggttttgcagagcttgagcatggcctttttgtcctcccaccttctggttcttgaagacattgccggtgacctggccccagactaacacaaggcgggcgtataccgtcagcctgcctggcgtccccttgcctcagcacacacagagacctcttgcaagatgcttctctgccgccataggctggaggttccccgggaactttcccttccttcctagctgaggaagatccctcacttccgctcgccgcgccaccggtcccacctccccgccccccgctgggtcctagcgccggcccctgtttggcagggtccgggctccgtcggtgcgaggagccgacgccgacgccacggagtcagcacaagtctcatcagagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggtaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83049 - DNA, 2386 bp, Homo sapiens
tcagaggatgttttggggtttaccttggctaaagcatgtcttcctcaaagagatatgcatcaacattccaattcctccaaccctgggtaagaaagcaacagtatctgtgcagtagggttcactaagagatgggttcagcctccccgccccccgctgggtcctagcgccggcccctgtttggcagggtccgggctccgtcggtgcgaggagccgacgccgacgccacggagtcagcacaagtctcatcagagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggtaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83050 - DNA, 2338 bp, Homo sapiens
gaggaggaaagaaaacacaaatgctggggacctgtcacttccagacagtgccagctaccagatttagcccattggctcagcccttttctggtcccaggtctgtcttttctgggcgcttggagaccttcaggccaggcccacgtctgggtacactctttatcctggcatagttcttggacactgagctgaagaaggaagatgagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggtaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83051 - DNA, 2348 bp, Homo sapiens
gaggaggaaagaaaacacaaatgctggggacctgtcacttccagacagtgccagctaccagatttagcccattggctcagcccttttctggtcccagtggctctgcggacacttggtccaactcctttcttcaatgagcagatcagggaggaaacgaacgcaggatgtcagagccaggaatgctgggcaggaaggatgtgtgggttccgagagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggtaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83052 - DNA, 2219 bp, Homo sapiens
  misc_feature (60)..(60): n is a, c, g, or t
ctccgcccccgtggtctaggcggccctgtggcaggtcgggtcgtggtgcagagccacgcnacgcagagtcagccagtctatcagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggtaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83053 - DNA, 2393 bp, Homo sapiens
gcacgctaagctagccacacttccggcaagagcagctagaatcgttccggtgcatattgaataggcgcagaaagggagaaaaagattctacagccctggccacagtactttggtgacacttttcgtggggctctctggaggacttttcccaaggcagatggagaaaacttcgtgaaacccactccttgctattaaaggaaatgttgtggaatataattggacttaggttttgcagagcttgagcatggcctttttgtcctcccaccttctggttcttgaagacattgccggtgacctggccccagactaacacaaggcgggcgtataccgtcagcctgcctggcgtccccttgcctcagcacacacagagacctcttgcaagatgcttctctgccgccataggctggaggttccccgggaactttcccttccttcctagctgaggaagatccctcacttccgctcgccgcgccaccggtcccacctccccgccccccgctgggtcctagcgccggcccctgtttggcagggtccgggctccgtcggtgcgaggagccgacgccgacgccacggagtcagcacaagtctcatcagagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggtaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83054 - DNA, 2249 bp, Homo sapiens
gcacgctaagctagccacacttccggcaagagcagctagaatcgttccggtgcatattgaataggcgcagaaagggagaaaaagattctacagccctggccacagtactttggtgacacttttcgtggggctctctggaggacttttcccaaggcagatggagaaaacttcgtgaaacccactccttgctattaaaggaaatgttgtggaatataattggacttaggttttgcagagcttgagcatggcctttttgtcctcccaccttctggttcttgaagacattgccggtgacctggccccagactaacacaaggcgggcgtataccgtcagcctgcctggcgtccccttgcctcagcacacacagagacctcttgcaagatgcttctctgccgccataggctggaggttccccgggaactttcccttccttcctagctgaggaagatccctcacttccgctcgccgcgccaccggtcccacctccccgccccccgctgggtcctagcgccggcccctgtttggcagggtccgggctccgtcggtgcgaggagccgacgccgacgccacggagtcagcacaagtctcatcagagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83055 - DNA, 1685 bp, Homo sapiens
atatcttggtctttaatgtgcagagacaggtctttggaatagagacacccagccagcctgaaggcttcttcctctggggtgcagccatgtggctcttaggggattaagcctaggcccccacgaacgtttggggagcccctaaagtacagcccagacaggcagtggggtcacgttatgggtctgtcgccttcatgccaagtcctccacacccccgcaggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83056 - DNA, 2303 bp, Homo sapiens
tgctgaggtactctagagtgatccccgttcctccccgttggagaaggcaggcaagggctccccgagcccaggaaactgcatctagaggtggaggattgagaattgtggctggaggttcggtcgctgccgggaggaggactctgtcgctggagctgaggctggaaaaagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggtaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83057 - DNA, 2090 bp, Homo sapiens
acggagtcagcacaagtctcatcagagaaaccccgttcaccaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggtaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83058 - DNA, 2368 bp, Homo sapiens
gcacgctaagctagccacacttccggcaagagcagctagaatcgttccggtgcatattgaataggcgcagaaagggagaaaaagattctacagccctggccacagtactttggtgacacttttcgtggggctctctggaggacttttcccaaggcagatggagaaaacttcgtgaaacccactccttgctattaaaggaaatgttgtggaatataattggacttaggttttgcagagcttgagcatggcctttttgtcctcccaccttctggttcttgaagacattgccggtgacctggccccagactaacacaaggcgggcgtataccgtcagcctgcctggcgtccccttgcctcagcacacacagagacctcttgcaagatgcttctctgccgccataggctggaggttccccgggaactttcccttccttcctagctgaggaagatccctcacttccgctcgccgcgccaccggtcccacctccccgccccccgctgggtcctagcgccggcccctgtttggcagggtccgggctccgtcggtgcgaggagccgacgccgacgccacggagtcagcacaagtctcatcagagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggtaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaacccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83059 - DNA, 1972 bp, Homo sapiens
gcacgctaagctagccacacttccggcaagagcagctagaatcgttccggtgcatattgaataggcgcagaaagggagaaaaagattctacagccctggccacagtactttggtgacacttttcgtggggctctctggaggacttttcccaaggcagatggagaaaacttcgtgaaacccactccttgctattaaaggaaatgttgtggaatataattggacttaggttttgcagagcttgagcatggcctttttgtcctcccaccttctggttcttgaagacattgccggtgacctggccccagactaacacaaggcgggcgtataccgtcagcctgcctggcgtccccttgcctcagcacacacagagacctcttgcaagatctttgctgacccttcagtgttccgcaagcaccggcgtactcacgctggcctgcggccctacagctgtgagcgttgcggtaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaaaaaaaatgcaaggaggaacaaaagagaaaagttttg

SEQ ID NO: 83060 - DNA, 374 bp, Homo sapiens
ggccccttagtctcctttttgaaagatcgttgattaattcaagaaactacgtcattagttctatagactgtctcatctggatttagatgattgcttccttgaggtggcatttattttgttttctcatcctcgtgtttcctatttactgacatttagagctagaggcttgattagattcaattttgattattttttaagagaaagactcattttaggcagtgctgtttactttctattgtattttatcatgtctaattttatcttttttttaattgatgctgggattgatttgtcatttcagggtgtttgtcgggctgatctctccattgtagcttttcccaccaacctttcttctgttggttttagcagccatt

SEQ ID NO: 83061 - DNA, 166 bp, Homo sapiens
aagctggaaacgcccatcccttggactagtcattctcccatttctgagatacatcctggaaatcatgtcaatagagcatcagctgtaatgaaaagtcagtaggccgggtgcggtggctcatgcctgtaatcccagcactttgggaggctgagcggggtggatcacg

SEQ ID NO: 83062 - DNA, 472 bp, Homo sapiens
tgcgagtcctgtgagcatcatctcagcctggcctcaggccctggagggtctggaaactgagtggtccctctcaggaggcaaccaaaagacgttctcactggctgacgatgggacacttggagcatcactgtgggcaataacttggagtgatttaaatacgtgagataaggccgggtgcggtggctcacgcctgtgatcccagcactgtgagaggccgatgcgggcagatcacctgaggtcaggagttcgacaccagcctggccaacatggcaaaaccccatctatactaaaaatacaaaaattagctgggcgtggtggtggcacctatgatcccagctactcaggaggctgaggcaggagaatcgcgttaacccagaagcagaggctgcagtgagccgagatcgcgtcactacactccagcctgggcgacagaacgagactccatctcaaaaaaaaaaaaagaaaagaagaa

SEQ ID NO: 83063 - DNA, 183 bp, Homo sapiens
tttttatcacataccaagatctgacaattctattccatgaaaaaaatcttttgagtctgacctcttctccaatcccattgcagctgtctcctaagttttggaatagtttcctaaatggtctcttggcctctgtattcgtctgttttcacactgctgtgaagaaatacctaagactgggtaatt

SEQ ID NO: 83064 - DNA, 833 bp, Homo sapiens
aatgtagttctttcagtttctcttctcatattgatatataaagccttgggaatagcagcaaactgttactgctcattattcttcactgccttcttttggcaaattggtactggagtaactgacagggttctcctaataggatctttcttgtggcaccctgtaccttttcatatattagcgtttttactgtctgagaaaggagatgcaaggaagtttacctgttggtactaatttttaagttgcttccttttccattgctaagaaagaagagggctttcttagttactggccaactctcttgaacactgtatggaagccatatggattggaaacattagcctctgctatatttttatagcagatgggtacacacatttgcattaggaattcaatagttctatgcttttgttagctttgtactccactcctggacaagaaataacccttcacatggaacctatttttctctccttccaaatgccagtctgctgttcaaaggccactcttttttttttaaatgaagtaattaatagggcagttggactccaaataagtcacttgagagcagtaagatgtagttgtaaataagctttttgaataggacccagcagtagctcatttaatatcacctgagatattttacaaactaaggattgttgtgatgtcaaactatttgattctacatgttgtttcgatacgtggatatcaagatataaagtagcagttggctacctaaaatgaaaagagcaatgttccatggcacctgaaatgttaaaaatattagaaactctccccaccccatattcctcccaccccaattgagtctctcgcaa

SEQ ID NO: 83065 - DNA, 311 bp, Homo sapiens
ccagtatgaatgtgaacaattccaaatatatatactaaatattcactttcttttattttttctttgactgacactaaatattgaaacaaaaatggcttagcaactataatgcctaaaagggaactatgatgtagtatgtatatgtgcatgtgtatacatatcctaaatatacatatatacaatactcttcgtttatctgcagtttcactttctgcaattacagttacccactatcgaatattgtctgaacatagataagtatagtacaatacaatattttgagagcgagagaccgcattcatataactttt

SEQ ID NO: 83066 - DNA, 547 bp, Homo sapiens
tattgactaagtttacctcttacatgggtgcagttcatggtgtcccaaaacaatgacaatagtaacatccaagatcactgatcacaaatcaccataacagatatgataatgaaaatgtttgaaacattgtgagaattaccaaaatgtgacacagagacataaagtgagcacatgctgttggaaaaatggcattgatagacttgacagggttgccacaaaccttccatttgtacaaaggcaatattcgtgaagcgtaataaagcgaagcatgataaagtgagatatgcctgcaactgaaaaacattccttctcctttcgagtctatagctcatggtaaggagagggtatgggagccaagggtgagtttcatcttagctcagtgttaggctctggtctgaatcgcagcttcatcactgtgatgctactcaccctatggctctgagaagctaaggttcctgagtactaaaagtaaaataaaaataacaataaaaattaaccaattataaggccttgttttctttaatttttaaataactttttcttttag

SEQ ID NO: 83067 - DNA, 2313 bp, Homo sapiens
  misc_feature (1299)..(1299): n is a, c, g, or t
  misc_feature (1320)..(1320): n is a, c, g, or t
catagtgtgtggtgcacagtaggcatggaataatgataataaatggattaaatggatgcatgaaggtatacaggagactttaagctatcatagacggttccaggcaggagaatatgaagatgtaatttcaagtacagttgttattgtcagttttgctttccatggtttcagctacccatagtcaatcacaatataaaaatattaaatggaacattccagaaataatacataagttttaagttgctgaataatgtgatgaaatcttaggctgtcccacttcgtctcgcctgggatgtgaattgtccttttgtcctgcttatgcacgctgtatatgttacccaccgtttagtcacttagcagccatctggattctcagattgaaaacagtgtgtatagggttctgttctatcaaatgtttcaggcatcctctggggggtcttggaatgtatcccccatggataagactacttgtataatctggtaaaatggatgaattattcataaataatgtcagaaccagctatttcaaacaagattagattctctagcctcatatcatatgcaaagataaattatatatggattaaggatttaaatgtaaaaaaagaaattataagagttccataccgaaatgcaggtttatatttagtaaaatagtcaagaaaggtttttttttttttttttaaaaagcataacatcaaagcctaaaattacaaaggaaaagagtggaaaattcatccccataaatattaaaaactagtgtgttgcaaataaattcaaaagataagggaaatactggggaaaatatctgaaacatgacagagtgtcattaatatatcatgggcttttacattttagaaaaaaatgacggatatctcactagtgaaaagactataggaaatgaagaagtaattcacagaaaaagggtcaactccatttatcagagaaatgcaaatgaaatcaggattgcattcttcacctgtcaaattggcagatgcaacaatagctggtacttactgagccctttctgtgttagctactagtctaagagttaccaccactcatacatatgtaaaggctaatggagttgtaaatgtaacttttgaggactttattgtatgtatgcgtattagtctgttctcacgctgctaataaagacatacccgagactgggtaatttataaaggaaaggaggtttaatggactcacagttccacatggctgaggagacctcacaatcatggtagagggtaaaggggtagaaagtcatgtcttacatggcagcaggcaagagagctngtgtaggggagctcccctttntaaaaccatcagacctggtgagacttattcacatgagaacagcataggaaagacccgccccgatgattcagttacctcccaccaggtccctcctacaacacgtgagaattatgggagctacaattcaagatgagatttgggtggggacacagccaaaacatatcagtatgttatggccttatataaaagttgttttgtttgtaagcagtttgccctacagtgtgtggaaagtgcatcactgttgtgctttggttgtccaactctttgcttaccctgatgcttaggtgtgagttgatggcagtttggcatttggagagcagttgcactcctaaaatgagtgaaatgttctcttcaaacttgtggcgtaccgtctttctatggctctgtgacagttacagatccgaaaattaggtgtaatggcttttgaagcaaaaatctcattctgaataaatctcccatctgttccaataacattttaattgcgcatcaaatatggtacttatttttaaaaactgcctagcaggatagtttgtgttactctgcctgtatccatgaccgtgataagaaatgtaagaaaaggccaggcatggtggctcacacctgtaatcccagcactttgggaggccaaggtgggtggatcacctgaggtcaggaatccagacaagcctggccagcatggagaaaccctgtctctattaaaaatataaaaatgagccagatgcggtggtgcatatctgtaatcccagctacttgggaggctgaggcaggagaatcgcttgaacccaggaggtggaggttggagtgagcgaagatcatgccactgcactccagcctgggtgacagagagacagactgtctcaaaaaaaaaaaaaaaaaaaaaaatgtaagaaaagaggttgagtcttattttcatttgtatttctctcactgcctagcatagtgcctttcactcagttggaatatataataaatgttcattaaactgactattgt

SEQ ID NO: 83068 - DNA, 297 bp, Homo sapiens
tgagatttttgcaaagccacgaattaaagcaatgtggaaattaaacctaacaatccactgtggttaactcagtgacaggattatccatatagtggcggcacagtgtggcaaggcagggagagtggaagcttgctggtagaagcctgtgttatctgctggctacagtgagggcacactcaagggccaccagggctcctgaggccacttgccgccgagagccaaatcaaccacttccttcctttcccactaaaggctaggcagcccctggtggctctggggaaagcccagccacacagc

SEQ ID NO: 83069 - DNA, 476 bp, Homo sapiens
caagcacgcaccagtggggtgagggaggacaaccccaactggggcccaacactccactacttaacgtttcaaaaaataaaatcaactgtgtataaaatcatatttatacctagaaggtctagtgcgacgacacaaagaaagcaattataagaaaggaactaggctaggcaaggtggctcacgcctgtaatcccagcactttgggaggacaaggcaggcaaatcgcttgagccctggggttggagaccagcctgggcaacatggcaaaacctggtctctataaaaaagtataaaaaaaaaaattagctgggtgcggtggcatgcacctgtaatcccagctattcaggaggttgaggtgggaggatcgcttgagcccaagaggttgagactacagtgagccatgatcattcaactgcactccagccttggtgacagagcaaaaccctatctcaaaaaaaaaaaaaaaaaaaaaaaggg

SEQ ID NO: 83070 - DNA, 629 bp, Homo sapiens
tctttgttcctggcagacatgtgtttagctagaatgcaagggttcttttactgaaaaagaggagaatggacactggaagagaactatcagaatctgctacacaattattttcccagcacatcttgaattctttgaaggataagaggtctctcaacacgtagaattaaaaggaagagcccctaaggggaaagcaaaaagataatttgaaatgatatccctctgagggcttcacccctggaacagcccacttcctattgggaacatttccttttgatatgtagacctatgaactaaagaaacaaaactctcttgcacattcccaacatgcagtaatggaacaggtagaaaatactgctatgaacattgctttttaaaaaggaagaaaattgatacacacaggattcactggtccacagcaattttgaaatctagctggacatatgttgccagttccttgattaaaggatcaattctactgcctgggaacaattcactttggctcttggctctaccctcttggccatcttcattttccatggaaaatagcccatgtttatggctgagtaatttttgcagcctgtttctgcccacagaaatttggatttcattttgtattttctatatctttc

SEQ ID NO: 83071 - DNA, 310 bp, Homo sapiens
ttttttttttacacagtttccagtcctggaaacctttagctaatctttagcattccttcaatggtgggaatgggcaacagatcaccatagtattaatactctgtgtaattttatcactagaatggttaatttccatatcatagtagagctgttgcagatattttgaaatcccattatactcactgccacttcaagattactgtagttgttagaacagctactagatcttattacttaataaattaataaagtgtgaatataactatataaccattttaaaatgttttttgataactttcaatataattgg

SEQ ID NO: 83072 - DNA, 446 bp, Homo sapiens
agttcctgattattttcagtccatcagaggttaaggggcttatctcttgactaacctctcctccaagctgtattagtcaaacagttcaaacacagttggatcaacaagtcttctggtgaaataagattcgtgaagaatgccctgaatcctaggttgaaaggcctgagttgggcagaacagtgacgtatgaacttcagatgagggcctacacttctgacggcttagaccccactgtaggggagagcgctggctgcttgcacttgtagccccaccttattctgagtaatttttttttttttttttttttttttttttttaaccaaaaacaaaaaaaaagggggtggcaaaaatcctttattttaaaaagggtccccccccaccccactttggaaaaacccaaaggccaggaaacggggaaccgagctcaaatccgaaaccggggccaa

SEQ ID NO: 83073 - DNA, 768 bp, Homo sapiens
gggcaacatggtgagacctcgtctctacaaaaataaaaaaataaaaaaattagccaggtgtggtggcgcatgcctgtggtcccatctttaaaaaaaaaaaaattaacaaaatgatcctgtttcttagagaagcaactaatagagtggagtttgttgccagtgatgaaattcaaacttttggacaaaaattagaattttggaaacgtgtgtctacctgcatgagcttgacagctttctgttgtttaaagacttttctggtgagattggtggtgatatgaaaaatgtgaatttagcagaggacaaaaagttcattgatttggtttcaaattctaccttgtagctatcctttaaaaaactatacttctcaagatgtggtagagtatcaaagaataatatccacaattttctgaaaaggctactaacatattgttccttttccaactacatgtccgtgtgaggccgaggcaggcggattacgaggtcaggagatcgagaccatcctggccaacatggtgaaaccccatctctactaaaaatacaaaaaattagctgggtgtggtggcgtgtgcctgtaatgccagctactcgggaggctgaggcaggagaatcgcttgaacccaggaggtggaggttgcagtgagctgagatcacaccactgcactccaccctggtgacagagtgagactctgtctcaaaaaagcaaaaaatggacagcctcccaaaccagagtaggttcagagagactcttgtattaccatttaatgggta

SEQ ID NO: 83074 - DNA, 474 bp, Homo sapiens
taatgggtaaaggccagggatgctgccaagcatccttcaatgaacaaggcactcctcacaataaagaattatccaacccaaaatgtcagtagtgccaagattgagaattcctgtagtacagctgtctggagctgtagttgccagcatctgcagcaacctgtgcctgatgcctgcctctcatttactctgtagtctcttactggactcaataatcatttttctcttaacttttatcccagtactcccaatcactatatttgcaggtagcctcttctcaggcattcttgacttctttgtagtataacatattatcaacccctttaaatattaaaagttaaaattaaatattatataatttatggttcttgtagaaaaactgatatacaaagaagaaaaatttaaatgtttcataacctttcccatctagaaataaacactgttacaaagttggtatattcacttttattattaccc

SEQ ID NO: 83075 - DNA, 274 bp, Homo sapiens
ttaaagtactaattattgttttttaattgtaatatggatatgaactcaatgcagaaaacttggaaaacacaaaagagcacaaaggaaaatttaaaattggccataacctacccactgaaaggtcatcattaacatctaggctgatgtctttaccattttttcaatgcacataaatgaatgtgtgtaaataaatacatgctcttgctatcgaaatggcttcttagcaatgcagggggaatgttttcccaggtcagcaaatgttctccgtgactcc

SEQ ID NO: 83076 - DNA, 357 bp, Homo sapiens
ggaggtcaaggctgcagtgagacgtgatggcaccactgcactccagcctgggtgacagagtgaaaacctgtctcaaaaaaaaaaaagtttctttaattttgactccccagttctttttcacgtgaattgccacgatgtttcccccatggttaaaaatctgaatccaaacttgacatttctctgggctggcttttgacttattggtctgagcccatcattccaggcctgtcaagcttctaaattgaattgggtcattgacatactagctttccctataagttttttattatttacagatttggcagcaagattaatatttctgaacattgacattcaagaatagactaactacttcat

SEQ ID NO: 83077 - DNA, 412 bp, Homo sapiens
ttggagagacaggtttgcatagttgtttacagaggcaggctctgagaggggtgagcctgggtttcagtcttagttctcttgatcttgggaaagtcacttaacctcccaactagtctcctcatgtataaagcggagactgtaatattacttatgtcctaggatggctgtgagaattacaggagatagataaagagcacttagcccactgcctggcaaaagcaagcattcaataattatcagatatcactagtaattaataatcaggtagtgctattgttaacgttatcattacatcacagcactgcagaagatgaaagggcacctagaggttttttgaaaacacctgcgtcagaaattaacaaaagtccagacccccacccccacccaaaaaaaatgttagcaagattggaaa

SEQ ID NO: 83078 - DNA, 389 bp, Homo sapiens
agactgccaaacaagggaagcttgggcaaccaagaaactgtgtgaaagcaatgttgagatgggggtggcatggtttcatgtaggaaatctaaccatcaggatagagatttatagggaatttccacacagttgtttttttaaaacctcaagatttaatttgattaacagggacatgtaggagaaggcctagattgcaactaaaatatttagaggagacaaaataagtttaaatataatgaatctgaatttaagtttcacagtagttaaagtcggggtgaaactgccctgtgaacttgcttttgtgttcaatagtctctcctgtgagacaggtagcacaaagcttctttattctagctccatggcggtcaccttaacacttagcggctgac

SEQ ID NO: 83079 - DNA, 741 bp, Homo sapiens
gtcaggagggaagaagggagggtggggtggggttgggggagaggggaggacttgggagcctgtttgccctggaaagctcaatataagaaaacaaagaggatagtagtgtgggctttggaataagactcaggttcaaattcttactctaccaactagccagctgaattgccacagccatctctttgcagaatagcttggatgctcaattttcctgaacgatctccagcgagagatagaacaactatcaccacatttcatttaaaaatctcttcaagacccttcctcagttcttaaactggcaacctgcccagcatcagcctcacttgagaaattcgagaactacctgattggagaagagaactagatttatatttgttttgagtcacagaaaagtgacagtttaaattctgaaagaagatcacatttgtagtgcctctttggagacaaaaccttaggtcttggatttgtcacatgttagagctcaatgggagtttatcagtgctctccaagtccagcactcctatttaccagaggtgaaaaatgagtgtgagtgaggaaattattatttccagggccacacaatctaaaaaagtcagtgtcagtactagaaccagatgccctgatagcagttctctccctggcatctccttgcatttactttgcatttcactttggcaggagaagtaccagacacccttgagacacaagacaggatacaatggacatgggagtagatagatg

SEQ ID NO: 83080 - DNA, 661 bp, Homo sapiens
cttataacctctcaaattcattttgtttatttgaaacgtctcctgatttgatttatcagcctaagccatgcataacaacacaaatctacttctttccaagcataaaaaggaaagagatgggagagaaaatgaagtgaaataatatttaggtcatgtcttatatgggaaaccaaagctagcatttgtatttcattgcttaaataagtaaggaacatgtaattagtacttaaacatatatacaaattgtcttttaacagtagaaaaactagattcttagttaaaaaaaaaaagatgtgtagaacaaacattactgagttagtaatcagaagatctgaaatctagatctacttttaagaaatccaaccattccaagactgaagattttcttggcttatgagactgtaactgctaaaaccaggagagagctggggaaatcgagatgattgctcaccctagtgtgcacactggaaacagtcggctgatacctccatcctcatcttcgtcatgtcattgaggggttaaagaaaatcattgctgtggttcctttcagatctaatgttttgggagtctaaaaagtagagctgggcattttccccagtagcatcctatttcactgtgagaatagtgtgtcatatttccaaaatacaaatgcatgttagaa

SEQ ID NO: 83081 - DNA, 548 bp, Homo sapiens
tacacacagtcatatacttggttccagccactggaactatgccattccctgaactggccccacttgctcgtctccaggccatcacagatagttctgtgtccttagaatgcttgtccccttgcctttcaagagttctccaggactaccttagatccttatttcctctaggaagacagggttgggtgctcccgcctgggtatccaagcatgagtggcattttcacactaaatgctgaaagtctgttgactgggggatgccccacagcagataaaggcttgttctcacaatgcagctcccatgtgtagcccaaagcctggtagatgctcaaaaaatatttgtcaaatgaagaagaggaagaagaggagaggtcacatactaaacaaattggttggacctcattcctaaacaaattggttggaccagtctctgaaacctaacaaacaagacttgcatacacctggccgggcgcggtggctcacacctataatcccagcaccttgggaggctgaggcgggcggatcacgaggtcaggagatcgagaccatact

SEQ ID NO: 83082 - DNA, 272 bp, Homo sapiens
taaagcttaatgaacaaatgattataagcataaaatgtaggttatgtgctggcatttgggtatttaagaattggctaacttttatggcaagattttcagactcttaatcagaggaatactgtggttctagtaagtgcatctgcattgcagctaggtagttaacaaagtatcttgaaaccttttagttaagatgaggaaatagccaggcgtggtggctcacacctataatcttagcactttgggaggctgaggcgggcggatcgcttgaggtc

SEQ ID NO: 83083 - DNA, 948 bp, Homo sapiens
tcccagcactctgggaggccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcgaaactccatttcaaaaaaaaaaaaaaaaatctgttaaaatttgatatagtaggcactgacaaaagaggtcaaatgcaggactgatttctaagcttgcaatctatctaaatgcagatgctaatttagagtgcataattattacacaagtacagacctaggttagggcttaaatttcattatgtgcaataaaaaggttaagtgatggttaagcaaggtgtagattatccttacctctcctaatgacatgggctcacattggcattcctttcatacttttacgtataaagtgggcagttgtttctgaatgactgttgctggagcctcaggcctgctttgtgcttggtgctttccagactttctcctttattcctatcaccatatacgtactcacaaaagagcagtgtaaaccaggtattacatttccacaagggaaagtagaaccaggaatagccacatgatacttaccgaaagcttcactttccctatagagaaagcaagcaacatgaatcttctgatttggggcccagcctgctgctgtatacagaggttggcattattggtgatagaaatgtctgataggagtcttttaattatactctggagtgtggaggtggagtgcaaggctgcttcctttattactgcaagtgttattttctattatctcaggtttcgttttgtgtaataaactgcttcttgttaaaaaatg

SEQ ID NO: 83084 - DNA, 895 bp, Homo sapiens
tcccagcactctgggaggccaaggcaggcagaccacctgaagtcgggagttcaagaccagcctgaccaacatggagaaacctcatctctactaaaaatacaaaattagctgggcgtggtggcgcatgactataatcccagctactcaggaggctgaggcagaagaatcgcttgaacccaggaggcggaggtggtggtgaaccaagatcacgccattgcactccagcctggacaacaagagcgaaactccatttcaaaaaaaaaaaaaaaaatctgttaaaatttgatatagtaggcactgacaaaagaggtcaaatgcaggactgatttctaagcttgcaatctatctaaatgcagatgctaatttagagtgcataattattacacaagtacagacctaggttagggcttaaatttcattatgtgcaataaaaaggttaagtgatggttaagcaaggtgtagattatccttacctctcctaatgacatgggctcacattggcattcctttcatacttttacgtataaagtgggcagttgtttctgaatgactgttgctggagcctcaggcctgctttgtgcttggtgctttccagactttctcctttattcctatcaccatatacgtactcacgaatagccacatgatacttaccgaaagcttcactttccctatagagaaagcaagcaacatgaatcttctgatttggggcccagcctgctgctgtatacagaggttggcattattggtgatagaaatgtctgataggagtcttttaattatactctggagtgtggaggtggagtgcaaggctgcttcctttattactgcaagtgttattttctattatctcaggtttcgttttgtgtaataaactgcttcttgttaaaaaatg

SEQ ID NO: 83085 - DNA, 851 bp, Homo sapiens
cggggatctataggcacacgatcacggggagagaagcagaaccactcggagagcacattgcaggggttcaacctcacgcagtgatgggagcgggctggacactgtgtgtgaagactttctttctgtgtctggtgctgggctctgaaatccatggagcacacagccaggaaggggaaaatgaaaatgaagtgaggaaaacaggcacaaccatgacacggaggctgagctggacccgccagggcagcccggaactgcatcctctttctcccctggcaaggcccatgcttccttaccgggcttcctgcaggagaagcggattccctccgtcatccagctaaacacacggacactgaaggcggctccatctggcaggagtggaggctgctgagggcccagtggctgccccacccacccggtcagccaacagcaggcacccatgtgggagccacagggaagcctttgccctcgctcttaccttctgagtctagaatcatgacaagccgccaaaacaccacacctgctaaatatcacacaaaatgtctctgggcctcacagcccaggaccaagcagggaagggaattcaggtaaacacagctccagtgtacttgtgttgacacagcctacgtccttcaaaaccagcgccgagctcaaggcacagagatgctgtttctggcctctgaaaactgagtctgctggggaagacaaggtgtacggggcttttcagactacactgagtgtcagagcaatgatcatgagagctcaggcccacaggacggaaaagggctcccatttgactctgtgaagtgtttggggagcacagagcagggtgataagggtttcgtggctggagg

SEQ ID NO: 83086 - DNA, 813 bp, Homo sapiens
ggcttgccactgttcccacacggctaagtgtccgggttcgtcctaatcaagctgaacactagtcactgggttccacggttctcttccatgacccacggcttctaatagagctataacactcactgcatggcccaagattccattccttggaatccgtgaggccaagaaccccaggtcagagaacacgaggcttgccaccatcttggaagcagcccgccgccattttggaagtggcccaccaccatcttgggagctctgggagcaaggaccacctggtaacaataggccaaatactgtgctgataagcttgaaagcctgccctgaatcctcatctattgatggagatggtgtcatcttgccttgattgtatccagaagcttcatccccaagataaaggatggacatctctccgatgaccagcttcttttgctcgactctagagaaggttgctttctgcattctggcaactgccctctgtctacatgattagactcgttggttgcagtgctttctggagtaatgaagggatccagtgcacagggtttaacttactgggcacaatctctaagccaactctgcctgaatgggtcccctgttttttctcttctgctcttgttgaaccatatctctgttccttgtgctcctgggaatttcttgctctggtcatgaaaaaaatggaaactctctcaaggaataacaatcagagctgtctggttgacaagggacattatggttgcaagaagaccctgaagcaaggattctacatcaaagattcaggggcaatctgagtttgcatttaagatccttctgcct

SEQ ID NO: 83087 - DNA, 306 bp, Homo sapiens
ctcccttcaggaaaatttcaaaatcatatgtgactcagtgaacttattgactaatatgaaaatgctatgtgtaccatagaatatatgctgggagcaaggttgcattggtgttaaatctacttaaactgtctagttgatttgttgatgattagttgtggcatatactttttttaaaaaagttaaataatcgtgtgtccgtggttttgagggaatgttgccaaccctttaggtataatcagagagactctttggcatattggccattgctgctgaaggttatcagtttttgtgtatgtagagggccta

SEQ ID NO: 83088 - DNA, 676 bp, Homo sapiens
ttacaggcacccgccaccacacccagctaatttttgtatttttagtagagacaggtttcatcatgttggccaggctggtctcaaactcctgacttcaagtgatccgcctgcttcagcctcccaaagtgctgggattataggcgtgaggcaccgcacctagccatctaactttaaatgttatttgttaaagtggaatctttgtaaatgtattcaaggactctatccagcatatttccttaagttttgccagatttacaacatttaggataaagttggttactatctagaatagaggttttttttgttttttttccctaccctagggtgtttgtacaattgatatttttagctttataaaataagaactacactaacataactctgaagttttaatagttaaagcaagtatcagaataattttgaaaaattttttacaataagtattttttgtctttctttctcccacatctcattagttctggtttccacagttgtagccataggggaatgccacctttaaagatgttctcatccttgtcttagttgagacacatgaagaacttactggacattttgtcagagcctgttcttatagcatgcccagatctgaagcatttctccaccagggtctatgaatggtcttcaggggatcttgaaataataggtgtatgaacca

SEQ ID NO: 83089 - DNA, 425 bp, Homo sapiens
ttagtgttgtggtgggaagtaaaggcttggctctgggaaacctgactgtcagcagccccccagtagcatctctatcaccaacttctggaagcattggtggtggaactacactggtgatcacaggaaatggcttctatccaggcaacactacagtcactattggggatgaaccttgtcaaattatttccatcaaccccaatgaagtctactgccgcactcccgctgggaccactggaatggtcgatgttaaaatctttgttaatacaattgcttatccacctttgctttttacatatgccctggaggatactccatttctcagaggaattatcccaagcagaggtccaccaggaactgaaattgagatcactggatccaactttggctttgagatcttggaaatctccgtgatgataaataacatt

SEQ ID NO: 83090 - DNA, 438 bp, Homo sapiens
ataaatgaaagtttcaagatggtaccagcatggtcaggttctggtgaaggctgtcttccaggttttagactgctcactccttgtgacatcctctcatggtgggaagggatgagcagctctgtgggacctcttttataaaggcgcttagtccatccatgagggctcagacatcatgacctaatcacgcaccaaaagccccacctgttaacacatgtcatcacctcagaggtgaggatttcaacatctggatttcaggaggacacagacattcagaccatagcagacaggcacctacagaaaaattgagtgctgttactggaaggtatgtggaggctgggcagcccaaacccagcacatgtcccccacagaaatggcactcacaggtcagctgcttgcctgttgacagctgtttgtgggaagggcaggggaggcctacag

SEQ ID NO: 83091 - DNA, 421 bp, Homo sapiens
ctctatgttctattacctaggatttcacataaagtaacacattctaaagaatgaagcttttcaaacctgaaatggaacatcttaacttcgcctgaatttgctactccttattccaggacaagacaaaaacaggaccataacttatgagtggagacaatgaatatgttatcaatagaaatgtacatttcaagataatgcaaatcctgcttcccagggtccagcatatgcctccctctctcaccccgtgggccaaggaagggctggcgccatcttggaccataaatcattgcagaacagttcctggagggcacaaacccccagggcagaaccttccacacagctaaagaatttcctgccaaaacagataagaatttcctgttttgcttttcattattactttaaataatcccattcagagtct

SEQ ID NO: 83092 - DNA, 465 bp, Homo sapiens
actatttctcttacggagcatatatgcatgcaaaattgactaaagaggactcatttaaaacatttctaaggggaaatttgagttaacacaagggtgaatatattttaagccagtttatattttaaaccactcaataatgtggttttgaaaagtgactttttagaatatgtatgtatatgtctacacacacacacatacgcacacatgcaaatgatgtgtttaccctgctaagcagttagattggtaactatgaggtagcagcttctgtatcttgttaccttgttaggtcagtaaagcaagtgagggggcactttattagtttgtggaccattcttgaagctggtgacgctgcaaagggtccaaggcttgccctctctgctagtctagatcactgtttctgagactgtaatgtatgtgtaaatcacctggaggtcttgttaaaagtgtagaccttgttttagagat

SEQ ID NO: 83093 - DNA, 502 bp, Homo sapiens
ccaggcaccaggcagcgggagacactgctgcagctcgaagcctgccggggcgccggcccctctgcggctgcttgcgccatcctgccccctccttcccaggggaggccccagtgaaggccctggccagggcttcccagccccttctgcctccggaccggcctgggtgcttcccgtgtggcccggcctggggcgacgtggccctcctctcaggaagcgtggtaatctctcaatggctggcctccggagttgtcactcaggctcccttgtaagttaaggccgggcccaggacactctagggcacgcagctgctgtgggactgctgggttaggtgtcccctggagcagaggcggcttcggatttctaaagtggctgagtcctttcaccttgcaccagaaatgctggatcaggcgcagcacacacagcacctggggatgcaagcccggccagccccatggaccaagccccgccgaccgtgtggcccgccgagcccaggtgcggccgc

SEQ ID NO: 83094 - DNA, 272 bp, Homo sapiens
agtgtttatcaccttcttaaatactgcatgattaagtcatttattatggtttttgttaactttctatctccccttgctacaatgtgaactacacaaggacaacatgtttgtggtttggatggctggggggtccaccagtgcatctcaagtgcctatatatatatatgaaacatatatatggaacactttttattttaatgagctattcagtatttcagtaagctattaaatggtgcttggcatacagtatgtaatcagtatatattagttga

SEQ ID NO: 83095 - DNA, 339 bp, Homo sapiens
atttgatatgatttctgtccacttaaacttaagattagttttgtggactaacatatatcctggagaatgttccatgggcatttgagaacaaaatgtattttgctgcttctggatggaatgtttcatatatgcctgttaagtccgtttggtctaaagtgtaattgaaatccattgtttctttattgattttctgtctaggtgatcaatctgcccatggtgaaaagtagagtattgaggtcccgtattatagtattgcagcctatctccctcttcacatcatttaaaaattgctttatgtatttaggtgggtcaatgttgggtgcatatacttttacaatt

SEQ ID NO: 83096 - DNA, 123 bp, Homo sapiens
gtgtggagctaggagcatcttaatagaggaagtgatcattggagtttttgttttaaaggattcaccaaatggacaaaatggagtcgggggagaattttccagcaaagagcagagtatccaaaa

SEQ ID NO: 83097 - DNA, 345 bp, Homo sapiens
gtgactttcagtaaaaggtaatgtattccctgagaacaagtaaatacttgggcagggagggatggtttgagtagaggtgaaaacagagaaatgatgggaagctgaccatatgtagaagaagctgaaaggtcatggtttcaaggccactgtgtttcctttcatttagagcatccacttttaaagatttatcattttcagtgacctgaaggcgtacaagataatctgtgtagatacctgaaactgcctttcaacaaggccagtcctaggtattgacagcatcctaggttgtcccaccctaaacattacctcaagtcccattgggtaggagtctagtggacttccaaa

SEQ ID NO: 83098 - DNA, 185 bp, Homo sapiens
aaacaacccagtcttaattcctaagtttatatttccatgacaaaaaaaaaaaagggggaccggaatgcattatggctttttggtaaaatgaacagttattactatctttggcaagaagaaacgtatttttttgacagcaaaaaatttttttgattgagcaaggtattttcagcttttcaaatact

SEQ ID NO: 83099 - DNA, 587 bp, Homo sapiens
cctcccgggggtctccctctgtgctggacagcgcacccctctcaatgtctcatcctttgcaaggaggcaccatttgcgtcatacagtcacatgtgtatagtttccatcatgctataaatagccttttgtgctccttttttaaattaaaaatacattgtaaacattgttccacatgctatgcctaatcctcaaaacacaactacccttttaagcacttcagggtattctgtgtggaacctcatggatggcttccccatcttccactgacgcatgcatacctcgcttttcaaatgttttcacggcatctttgttgatttggcgttttcctcctgttgaataatctcctcaggagaaattcacattagtgagatgcctggatcatttatcttgatttgacttttggtacatattattagatcgccttgcaaaatgtctgctacaggataagttttacctccccagcggagtgtatcacttcagctagaaactcattttaatatacatatttttttattttgtgggaataaagccatctcgaggttgttttaatttgatatcttgcaccgaggattaaagaaaagtaaagc

SEQ ID NO: 83100 - DNA, 328 bp, Homo sapiens
gatagtctttagaaaataaaatctgtgacactttaatcatttcattaagactgaagaaattaggagagactgaggataagtggttttccattttttttccctgggtcagccttggatacaggtgaattgactgaatggtgctagtaaaatggaagtaaaatcacatttttgtttttttattttgacatggagtttctctcttgttgcccaggctggagtgcagtgccgtaatcttggctcactgcaacctccacctctcgggttcaagtgattctcctgcctcagcctcccaagtagctgagactacaggtgcccaccaccacgcccg

SEQ ID NO: 83101 - DNA, 745 bp, Homo sapiens
cactcatgcttttgtggtcagctggcaagccagctggggactgccgggtcctggatgacccctcttatattgctggcagttagctggagtgatgggggcaactaagccacatgtctctcttcatccagcagaccagtcggggcttcttcccacgattgtagggttccgaaagcagcaacagaacacaaggtcccatatgcatgctctctttaaagctgcttcttctgttgtttgccaatgtcccagtggcatgagcaagtcacagggccaagcttatagactctgtttcttgataggaggagctgcacagaacttgtagctatttttttttcaatctaccataaccttaaacctaaatatgtgaagaatgtgatgtgatgtgtctgtgtgtgtgtgtgcacgtgtgtgtgtgtgtgtgtgtgtaaccataaactatattcatatctgtctcatggggaggattttcttctgtgtaatgtaaagaaattcaaagttatcaaagttccttaagtgtgtgagtttagattctttatgtgcctttcatgaacagatatgttctcattaatttcactggtggcacctgtaatatccacattgtgaacgctgtgtatgaaattcaactatactatgaatacactctgactcatgagaacttctgggttaaaaagccacaaagaagcacattttggtgaccatcattagtgacatcctgaactttattctgtgtacttgtgtcaataaatcc

SEQ ID NO: 83102 - DNA, 454 bp, Homo sapiens
aaatcattcacagagacgtgcaccgcggtgagtgtggactcctggaagcgcaccgtagctccgctgtgtcctgctgctcctccctagctgtcagggaggctgtagtccattgctttgccagctcttttgtttccgagtgaacaccttatccgtacacatgcggctgtctctgaccctacagaccagctgggatgccactgggggagcgctcccttccccccgcacttcccacactctgcagttattctgagatccttgagggcagggaacaggtttgtcttctttgtgttctcagaaattaatgctcggcctctggtcagcaagcaacaaccttttgttgagtgataatgaataaataaatgtttcccacatgagtattcagtaacctcagtgtcaggttcagccatctgttttggtggatatttaaaagaaaattccgcttttcctacagaaa

SEQ ID NO: 83103 - DNA, 765 bp, Homo sapiens
gctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccgtcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattgtaatggatgtggtaaggctttttaaaaaatcaaatgttcaaagacatagaatcaaccaaaatggccatcagtgatagactggataaagaaaa

SEQ ID NO: 83104 - DNA, 398 bp, Homo sapiens
ggagggaacatctttgagggtaattgttatggaaaagacatcctcagtgtgcacaaggaagcctctattggacaggaactttccaaatttaatccatgtggaaaagtcttcaccttaactccagatcttgctgcacatcttggaattctcaatgcaagacaaccatacaaatgtaaggaatgtagaaaaggctttaagtattttgcaagccttgataatcacatgggaatccacattggagagaaattctgtgaatttcaggaatgtaggagagccatcactcattcctcacacctaaagcagtgtgtaacagttcatactggaaagaaatctaaaaagactaagaaacatgggaaatccttcactaatttttctcaactttctgcacatgtgaaaat

SEQ ID NO: 83105 - DNA, 378 bp, Homo sapiens
ttcatttcagcccggtgatattgactttggactttggactgaggaaggataaatttctctttttttcaagccaaaaagtttgtggtagtttgctataatagctgcaggaaacttacacaatacccagctgaatttgaatctctcaaatggctttgcctctctgttcatcacaactcatttggtgttctactgttaggagattctttttttttttttcattagatgttcatctcaaagtaattgtttattgcagcagggcacagtggtacatacctgtaatcccagctacttgggaagctgtaaggtgggaggattgcttgagcccagaagtttgataccaacctgggcaacatagagaggccctatctcaaaaaaaaa

SEQ ID NO: 83106 - DNA, 1610 bp, Homo sapiens
acttgtttcaggtcaaggagctggaaagagacaggtcaagactctgtaggaggggaggaggcacaggacaggggtgccagctgctgaggccactagtcctgtccccaggccccaggggtcacttatgcccatgtgtccccatgcttcctggcaggactggtctggtgccatgccaagaggcagagcttgggaacttcagatccttgtgcctgcctggactgggccaggctggtctggggcagctgagggcacctgtgagagtgcaggggtacaccaagcagcgggcatcgtgattggcacgagccaggggagcggctggcagccttgttcctggtaaacacgaggagaggttacttcacaaggaaacagtaattaactttaattagcaccttgcatctcagaatattattaacatctcaatttctctaatcaagacagcaggagaggggcggcatctgctttgctgactccttcctggccatgctccctggcttggcttgggttcctgcccggcccccaccccttggaaggctcccaggagtacctcctcagaggcgagttgccaaggggagccggggctgaagggcagagagcaggtacgggccagggacacgccagccagccccagcagatgcagggcagcagggcaggggcaggactctttacctgccaccttatctttccaaatagactctaagcaccgaggacagcaaggcttctgttcccgatcccatgaatacacataatatagccttcttctctttctcccttacccctttcctccctcccttctttacttcctttgttccttctcttccctccttcccccttccctcctctctctctcccttcttcgagctaacctccttttctttttcccagtctctccctcatgctccctgtcctccccactggaattctccattttaacaagcatttattaagcagaccttacaggacaggggccctgctcccacaactggggatacagtaatgggcacaggataaatcctgcccttgggtagtttagaatctcacaggggagataaggctcgagtataaagaactctcatctgggcttcatactgataggcatcataatggctgggcagataaggggctgaggggttgtaggagggagggggacatgggagggaccagggccctagttgtggggcaccaaggcacgcggagggcagcaggatccagaggcagcgagggcacttggtgctgttcagccctctttagaaggccatcacaagggaagtccctgagggtgcagaaagtgactctcttcattgtacccaccctcagtggctgttaaccctgccacgtgtctgatattaataactgactgtcctccttggtctaattacagcggcctgctgcttgcacaatttgttatttatttggcagtgtcctcggggctatctctctagtccatccaatttgtatttactgagcacctactatgcctggagggctgggtctaccctggagtaggctcccagtgctggagctcctctctatagagactggagggatcaggagaaagctgcctacaggcctgggcatttcaggaaaaaaaaaaaaaaaacacaacacacaca

SEQ ID NO: 83107 - DNA, 857 bp, Homo sapiens
caggagcctcactcgtagaaagtgaacaggtacaactccaccctattgataggaagccaggcagcatcacaaatatgattttgcaccatgagaccattccattgctacaaataaaggcacttggaggaaaatggaaaacacaatatttatgctcccacagcactttgtacttctgcctgtcaatcagtttgctctgccctgtgtgatatgtgtgtgcgtgtccatgtattctctaagctccttgcagttgtgaatcgaatgtgttcattttcttatctcctcccgggaccttgcatacatgtgctaaagttagtgtgctcttttttctttttgcctttattagctaaaattgatactttgttgatgcatttttttttttttgaaaaaaaaaaaaaggagagactaggacagaaaaggagagactaggacagaaaactctgtagcccatgctggctgtaaatcacgcacattccagaggcgctgcatgccagggactgattctcattaagtttgccctctcatatgggatacatttggctgagcaaggatttcctcagagtccgctgtccgtctttcaattgaaggcagcttgaaaggtgcttagtcagcgaccaaatgctgaagccaaggcactgtgtgctgttttaaaggcctagtgaagccagagtcctctggaaggatccatgcgatttgaagttattagccacggtgctgcaaacagaagaattaacactgagttgttgacataattaaatataaggttactgcctcttcttcctcctttacaaaggaggaagacaataaattacaaagacaataatagaggggcactgtagaaaaaaattttttattttttt

SEQ ID NO: 83108 - DNA, 412 bp, Homo sapiens
caccagggagaaccaatacaacagaaaaaaagcagagaacagctatgtgtcctgccaggtctaccaaagatagtcatccaaacatgaacagatgagaaggctgtttttcaagaaggtgaaagtgacagaatattcaatgaatctgaacacatgaagatactgagacaccagtagttcagcaataagtggagagaaaactaagcaaatgagaaacttaggaacaattatgcagcaaagaacaactggataagctgaaaagtgtttaaagatgctgccgtaaacactaagtatcacaatcaaattctgatttgtaaaaatagaggtatgggaagggtacaagtatgttgtgggcaaaatggtgaggagagctaaaccctcttcttccttaatgagaaataaataatccaattaa

SEQ ID NO: 83109 - DNA, 531 bp, Homo sapiens
gcaagatgggtgtaaatctttctagagcacagctgaaaagttaaatggcttgtcctagagtacacagctcagcagagccaagagtaaaatggaaatccagtgcttttccatctatgctgcagtgaacctccactagagttttatgcaagtccaacctcccagcaatagggagaaaaagcaattatagcctttcttgatatttaacctagctaaaaacttcagcccagagaaaatcttccaaaagtccaagacagacaggcacttctaccgctcaccaccctccaaaagggactgagccctaagcttgtgcagtgattaatgctttccatgtcttttccatccgcctgcagttatgctacaagatctctgggtaaaggactagccaggtctgtctaacacatactttttggtgtgacttaacagactggtttctaccactttcagcctgaagtgacagtgcttttaaatgttggttgcaggcaggggactattgccccctcccaagcacttcaacttccttggcttctgtct

SEQ ID NO: 83110 - DNA, 314 bp, Homo sapiens
ttagtacctgaaattttcgcttactaaagtaacaaaaggcatgagacttggctattgatttttaaagtggaataacttttctcccctcaaaaatgtctttcttactcatataaataatgccttttacttgtatatctttttactgttcaaagcacttttgcagttatgctattgtttccctcacaacaatactgtgagggaggtaaagtattattattcccattttagagatgggtccttttgtaactgcctatgcttacacagttcattaatggaagggcttgaacttaaactcttttatggagtcctggagt

SEQ ID NO: 83111 - DNA, 892 bp, Homo sapiens
ccacacctgaggatggccacttcttgctcctgccgggcagggctcctggtgcaggttccactgacatcacagcaggggcagcctcatgaccggcctgtgtggatgagacccctgaattcctgcttggccttctgtgacaccgtccctcattacagccttgcgagggtagagaactcaggctcgccactcggcttttgctggtgcgggtgggggtggagccaccgttttttctgtgatgtgtggctgcagtagggttgttattatacaaaagttttctgtcttgctaggctgccgtttcccggtcctttgccaagagagcaggcttctgttgggactgttttgtctgtgctgttggtgttcaggttgctgggttcttcaactccagatctggggtacaggcagcaagaagctcaccccgtgttgctctgcaggccccgaggtcccagctggtctctacctttcagagtcttcttacatttcttgcctatatagtttcagggttctcagttgtagtgggcaggaggaaggggaaagtgtgtccactccatcttcccagaagcagaagttccctagatgagtatttttagttcctctataatagtttgtggttgtcctctctctcatttcaggtcaagctgttttgctcatctttgtcctccctactgtgcatggacagccccatgatcttagtggatgcttaggaaatctgtgttgagttcattacatacaactctatctaggagtttgtcatgccaatagcacatgggcacctgctcactcttaagagccagtcctttgaagggtagtgagtgcttctaggacattggaattgaacagatgcttggtgctatggagtctggttcattagagggttagctcatttcctgggaag

SEQ ID NO: 83112 - DNA, 407 bp, Homo sapiens
ggccccagggaagtccatggaggcctcggtggatgtgtctgcacccaaggtggaagccgatgtgagtctcccctccatgcagggggacctgaagaccactgacctcagcattcagcccccttctgccgacctgaaggtccaggctggccagatggatgtgaagctcccggagggccaggtgcccgagggagccggcctcaaagagcacctgcccaaggtggagatgcccagtttgaagatgcccaaagtggacctcaagggcccccaggtggacatcaagggccccaagctggacctaaaagtctccaaggcggaagtcacagcccctgatgtggaggtgtctctgcccagcgtggaggtggacgtccaggccccaagagccaaactggatagtgcacagctggagg

SEQ ID NO: 83113 - DNA, 461 bp, Homo sapiens
acaaaaacaatttaaaactgcgtaatggtccaaaccaccatggatggtgttctgacgatgatacacggggtgaggtctgactcatgagccgctgtccgtgatgacttgacattctcaaaaggaaatcccgaatgttctcactgcatgctgctgcaggccctcatggcagggcatccacaccactggctcaggtgctggttgctccagaatctctcttcagctggcctttttctactgaactgtctgtgagaacatcactgcaggcacggttttctccaaccataattgctgctgccaaagccacctcggacttgggaaagggaaacaacactccactagagagcgtagaatcttagaattcatctacttcattctcctcctggtactctactttcttctacaacgtcccagccgagctgaggtctgagctgtgctgctcaaggctgtcccatgtgaataca

SEQ ID NO: 83114 - DNA, 367 bp, Homo sapiens
atttttaaaagcttatgcaataaggaaataaagaaaggaaatattgtggtgcagctgtacagtgtgtttgtgttgtaaactgagtgcttttacagaagaatcaaacaaaaaataaagtttattgggaggctgaggcaggcggatcacgagctcaggagatcgagaccatcctggttaacatggtgaaaccctgtctctactaaaaatacaaaaaaatgagccaggcatggtggtgggcgcctgtagtcccagctactcgggaggctgagacaggagaatggtgtgaacccaggaggcgaggcttgcagtgagccgagactgcgccactccactccagtctgagcaacagagcgagactctgtctcaa

SEQ ID NO: 83115 - DNA, 1791 bp, Homo sapiens
gtaattattaactcttaggctcttcatttgccctcctaaagcagtgtttagagtcaggcagaggttaagtgtgttgcacctcacctagatacttccagaaccttctctgggtctgcagaatgtggcacaacctgcttgcccccgcagagagaaagctgcagtgcacatcctgcagactgcaggtgctgggctgcctctggagtcccagaaggcaagcttggctgcaggacagaaagggagaacagcttctctcacccctgagccttcacaagcccttgtctatttgccgttgccttcaaaatatacctcccccgaaaccagtagctttctgagtcctggtgtcccctccgccctttctggacaggtttgggaagaagaaagcagtcagtgctgggccttattggggtgtgaagcgccttgctctgccccttctgctcactgtgaaggccgctggatgcttctcttaggcatggtttaagcctccgattactaaaccccttgccccacaaacgtccacattgacgagcctctttttagtaactgcttccccgtaattccttcagaggttgctgtacccttcgctgatgtgctgccctcctgtaaaacctccagatgccttcccacgtaatgcccctttcagatgctttaagctgagagcttaaaccacaggtaccatggctgacgcctgccaggtttctgctgcagataatctatgatgggaggggcatattttttacttcattacttatgtaaactcttgttccagaaagctttaatgtgtgtgggagtgttctgggtctattaggtctgtgcgcatgggtgtgggcatttgcctgtgtccaccgggtgggtctcattatgaaatgtatgtttatgtagggctttaatggctgaaaatggcaaagagatgaatagaccacttggccccatgtgtaattgccaggccccttctgtgctcaaatgaggtgtccgagtgaaggtcagcccttcccttctgtatttggggcctatttatgccaccagtaattttataagaaatctgaatagttctcccctttgagtgcatttaactctttagtatcttctctcttacctatttgagcccctctagctacagtctggcttaaatgaaaggggaattatatgcttaagaaaaagtaggacacggttgaggcagtttgctgactgaatacgcgaagaaggacctgatgggctcatatgcaccactgccatcacagtccccatcgtgatgcaagcttatatgattcttgagaaacagcccagatctcctcttaagcggaaaagagattgaccttctagcagaggcaaagaatggagtcttctgggggcagctgcaaagcgttctccctaggacagatggagcctccctttcctcatctactctgtgggtggtttcagggcccacgagtcaacatgaggagttgtgctggtggtatgtgtgttggaggctgggctggctgattcacagtgacgaggatgtcaataataacaagaatgagaatgatgatacctaataaagactttttttcccaagacccatctacaattctttcattgggtgttttgccaagtctttctcaatctcatctcagctttttttttttttttaaagaaaatgtattcaatacttaattgcatcacaaatgtagacatagaagaaaggacttcaaacggaatttatgggaggcaatgtgtgcggctttttgccttatagagctgtgtagaaggtctggaatgatcttccagcaccaaatttagatggcctcaaaa

SEQ ID NO: 83116 - DNA, 1896 bp, Homo sapiens
gtaattattaactcttaggctcttcatttgccctcctaaagcagtgtttagagtcaggcagaggttaagtgtgttgcacctcacctagatacttccagaaccttctctgggtctgcagaatgtggcacaacctgcttgcccccgcagagagaaagctgcagtgcacatcctgcagactgcaggtgctgggctgcctctggagtcccagaaggcaagcttggctgcaggacagaaagggagaacagcttctctcacccctgagccttcacaagcccttgtctatttgccgttgccttcaaaatatacctcccccgaaaccagtagctttctgagtcctggtgtcccctccgccctttctggacaggtttgggaagaagaaagcagtcagtgctgggccttattggggtgtgaagcgccttgctctgccccttctgctcactgtgaaggccgctggatgcttctcttaggcatggtttaagcctccgattactaaaccccttgccccacaaacgtccacattgacgagcctctttttagtaactgcttccccgtaattccttcagaggttgctgtacccttcgctgatgtgctgccctcctgtaaaacctccagatgccttcccacgtaatgcccctttcagatgctttaagctgagagcttaaaccacaggtaccatggctgacgcctgccaggtttctgctgcagataatctatgatgggaggggcatattttttacttcattacttatgtaaactcttgttccagaaagctttaatgtgtgtgggagtgttctgggtctattaggtctgtgcgcatgggtgtgggcatttgcctgtgtccaccgggtgggtctcattatgaaatgtatgtttatgtagggctttaatggctgaaaatggcaaagagatgaatagaccacttggccccatgtgtaattgccaggccccttctgtgctcaaatgaggtgtccgagtgaaggtcagcccttcccttctgtatttggggcctatttatgccaccagtaattttataagaaatctgaatagttctcccctttgagtgcatttaactctttagtatcttctctcttacctatttgagcccctctagctacagtctggcttaaatgaaaggggaattatatgcttaagaaaaagtaggacacggttgaggcagtttgctgactgaatacgcgaagaaggacctgatgggctcatatgcaccactgccatcacagtccccatcgtgatgcaagcttatatgattcttgaggtaactctaccagatacttccagatttagaaatgtgtcaaaggaaaaattggtgatactcttctttcccctgccagaaacagcccagatctcctcttaagcggaaaagagattgaccttctagcagaggcaaaggtaaactcctgtaagttacttctgttaccaaagggaggggggcggcttttgtgaatgtatgaggagcttttgccagagagatattcggaggaggggtgtgcccatatgcacacatatattttcccgcataaccgtatccaatgctagcatttagaggaaggcatttagccaccaaaagtccatccatctatgctgcttccacagagaaaacattttctctttcctcctcttgaacttacataatatcctcctcccattccaaccttagaatggagtcttctgggggcagctgcaaagcgttctccctaggacagatggagcctccctttcctcatctactctgtgggtggtttcagggcccacgagtcaacatgaggagttgtgctggtggtatgtgtgttggaggctgggctggctgattcacagtgacgaggatgtcaataataacaagaatgagaatgatgatacctaataaagactttttttccc

SEQ ID NO: 83117 - DNA, 1552 bp, Homo sapiens
gtaattattaactcttaggctcttcatttgccctcctaaagcagtgtttagagtcaggcagaggttaagtgtgttgcacctcacctagatacttccagaaccttctctgggtctgcagaatgtggcacaacctgcttgcccccgcagagagaaagctgcagtgcacatcctgcagactgcaggtgctgggctgcctctggagtcccagaaggcaagcttggctgcaggacagaaagggagaacagcttctctcacccctgagccttcacaagcccttgtctatttgccgttgccttcaaaatatacctcccccgaaaccagtagctttctgagtcctggtgtcccctccgccctttctggacaggtttgggaagaagaaagcagtcagtgctgggccttattggggtgtgaagcgccttgctctgccccttctgctcactgtgaaggccgctggatgcttctcttaggcatggtttaagcctccgattactaaaccccttgccccacaaacgtccacattgacgagcctctttttagtaactgcttccccgtaattccttcagaggttgctgtacccttcgctgatgtgctgccctcctgtaaaacctccagatgccttcccacgtaatgcccctttcagatgctttaagctgagagcttaaaccacaggtaccatggctgacgcctgccaggtttctgctgcagataatctatgatgggaggggcatattttttacttcattacttatgtaaactcttgttccagaaagctttaatgtgtgtgggagtgttctgggtctattaggtctgtgcgcatgggtgtgggcatttgcctgtgtccaccgggtgggtctcattatgaaatgtatgtttatgtagggctttaatggctgaaaatggcaaagagatgaatagaccacttggccccatgtgtaattgccaggccccttctgtgctcaaatgaggtgtccgagtgaaggtcagcccttcccttctgtatttggggcctatttatgccaccagtaattttataagaaatctgaatagttctcccctttgagtgcatttaactctttagtatcttctctcttacctatttgagcccctctagctacagtctggcttaaatgaaaggggaattatatgcttaagaaaaagtaggacacggttgaggcagtttgctgactgaatacgcgaagaaggacctgatgggctcatatgcaccactgccatcacagtccccatcgtgatgcaagcttatatgattcttgagaaacagcccagatctcctcttaagcggaaaagagattgaccttctagcagaggcaaagaatggagtcttctgggggcagctgcaaagcgttctccctaggacagatggagcctccctttcctcatctactctgtgggtggtttcagggcccacgagtcaacatgaggagttgtgctggtggtatgtgtgttggaggctgggctggctgattcacagtgacgaggatgtcaataataacaagaatgagaatgatgatacctaataaagactttttttccc

SEQ ID NO: 83118 - DNA, 2135 bp, Homo sapiens
gtaattattaactcttaggctcttcatttgccctcctaaagcagtgtttagagtcaggcagaggttaagtgtgttgcacctcacctagatacttccagaaccttctctgggtctgcagaatgtggcacaacctgcttgcccccgcagagagaaagctgcagtgcacatcctgcagactgcaggtgctgggctgcctctggagtcccagaaggcaagcttggctgcaggacagaaagggagaacagcttctctcacccctgagccttcacaagcccttgtctatttgccgttgccttcaaaatatacctcccccgaaaccagtagctttctgagtcctggtgtcccctccgccctttctggacaggtttgggaagaagaaagcagtcagtgctgggccttattggggtgtgaagcgccttgctctgccccttctgctcactgtgaaggccgctggatgcttctcttaggcatggtttaagcctccgattactaaaccccttgccccacaaacgtccacattgacgagcctctttttagtaactgcttccccgtaattccttcagaggttgctgtacccttcgctgatgtgctgccctcctgtaaaacctccagatgccttcccacgtaatgcccctttcagatgctttaagctgagagcttaaaccacaggtaccatggctgacgcctgccaggtttctgctgcagataatctatgatgggaggggcatattttttacttcattacttatgtaaactcttgttccagaaagctttaatgtgtgtgggagtgttctgggtctattaggtctgtgcgcatgggtgtgggcatttgcctgtgtccaccgggtgggtctcattatgaaatgtatgtttatgtagggctttaatggctgaaaatggcaaagagatgaatagaccacttggccccatgtgtaattgccaggccccttctgtgctcaaatgaggtgtccgagtgaaggtcagcccttcccttctgtatttggggcctatttatgccaccagtaattttataagaaatctgaatagttctcccctttgagtgcatttaactctttagtatcttctctcttacctatttgagcccctctagctacagtctggcttaaatgaaaggggaattatatgcttaagaaaaagtaggacacggttgaggcagtttgctgactgaatacgcgaagaaggacctgatgggctcatatgcaccactgccatcacagtccccatcgtgatgcaagcttatatgattcttgaggtaactctaccagatacttccagatttagaaatgtgtcaaaggaaaaattggtgatactcttctttcccctgccagaaacagcccagatctcctcttaagcggaaaagagattgaccttctagcagaggcaaaggtaaactcctgtaagttacttctgttaccaaagggaggggggcggcttttgtgaatgtatgaggagcttttgccagagagatattcggaggaggggtgtgcccatatgcacacatatattttcccgcataaccgtatccaatgctagcatttagaggaaggcatttagccaccaaaagtccatccatctatgctgcttccacagagaaaacattttctctttcctcctcttgaacttacataatatcctcctcccattccaaccttagaatggagtcttctgggggcagctgcaaagcgttctccctaggacagatggagcctccctttcctcatctactctgtgggtggtttcagggcccacgagtcaacatgaggagttgtgctggtggtatgtgtgttggaggctgggctggctgattcacagtgacgaggatgtcaataataacaagaatgagaatgatgatacctaataaagactttttttcccaagacccatctacaattctttcattgggtgttttgccaagtctttctcaatctcatctcagctttttttttttttttaaagaaaatgtattcaatacttaattgcatcacaaatgtagacatagaagaaaggacttcaaacggaatttatgggaggcaatgtgtgcggctttttgccttatagagctgtgtagaaggtctggaatgatcttccagcaccaaatttagatggcctcaaaa

SEQ ID NO: 83119 - DNA, 630 bp, Homo sapiens
taccgttctaatgaaaaccatatagctctattagttcacatttcattccaatgttaaaattttattctttagtatcttggacctgatagagcctaccaagcaccctttccttccttcttccttgccaacaaagccccagttttgttcagctgttccccctgcctagacccagggaatgaattctgtctcattatgcctgatctaagctggcttggtagccttattctccttatcagtgactggctttggttaggacatggaactcagtcccgacccataggacccaaggagacatctgctgaaggacttctgagaaagattcacttactgataaaaagcagcacatagggccgggtgcggtggttcacacctgtaatcccagcactttgagaggctgaggagggtggatcacctgaggtcaggagttcaaaaccagcctggtcaacatgatgaaaccctggctttactaaaaatacaaaatttagccgggtgtggtggtggacacctgtaatcccagctactcaggaggctgaggccggagaatcacttgaacccgggaggtggaggttgcagtaagaggagatcccaccactgcctccagcctgggtgacagagcaagactctgtctca

SEQ ID NO: 83120 - DNA, 247 bp, Homo sapiens
tttagtagagatggggtttcaccacgttggatgttggtcaggctggtcttgaactcctgacctcaaatgatcggcatacctcagcctcccaaagtgctaggattacaggcatgagccaccacacccagcctcaaaactatttaaaaaataaaattcttcaaaaaatagaacaaaacattgtatacatatataatgtttctattcatatatgtgtatgtgtgtgtgtatatatatattatatatatat

SEQ ID NO: 83121 - DNA, 347 bp, Homo sapiens
cagatgcccagtcaccaagttcctccactagatctgctgcacttagtcttccctgtggggctccgtgcctctccagcagaggagtaacccactggagttctctcttctaagatgtctccaacccaagggtaataaacaactcgagggtaataaacaacttgggttggcagcacagattaggagagggggtgtcagatcactaagctctgatcttgatcctctgctgcgaatgcgaagggcaccatttccaaatacagagtcctactgcatccccattggatttcagagcaaaagtgacagtggaatgtgggactgtaaaaactcccacaccagtaagtagacctcct

SEQ ID NO: 83122 - DNA, 738 bp, Homo sapiens
ccaggagccctctgaaagagaagagtcaactgtggagggggcacctgtgaatgaatcctgcggagctgctaacagagcagacttacacacacaacatggagactttcctgggcctgactcccggacctgtccccagcgcctcgcggcctctcgagccccttcagtgaccaagatgcagagatcaggacgccattgcaccaccccagggtctggcgctgtcgcccaggttggaatacagcggtgcaatctcaactcactgcaaactccgcctcccaggttcaagcaattctcctgcctcagtctcctgagtagctgagattacagatgcctgccaccacacgcagctaattggttgggtgtggtggggctttccaatgattacttattaatgattacttatgaaaaacaacaacaaaaaagccatcttgaagctgcttttaatgagagaacaaatgtgctcccaagcaacagagcagcgaaattctttattactggattctaactttcctctctaactgtaactgtctcagctccacctcatgtgacttggagggtatgttgcaacctgcgtcttcaccacccattcatgaagatctataaaactaatgtaaactgctggggcaatttcaacatgagtcaactggagattgttacttggtgagaatgcgcaagtggcaaagatctaaatttgttcagctaatttgtaattaaccttcgcttctcacatgtcagtatgtg

SEQ ID NO: 83123 - DNA, 448 bp, Homo sapiens
tcctcattggcaagacgggtataagatctactttgtagagttgttttgatgcatgtgtgaggcaacatatttaaacttcctagcatagtgcgtgcctcttagtaggattaatggttaagttgcctgcctgtgccctgttgaatagactatgtttctctgtctaaaggattttatctatgatcataaccttaacaagcctattatgcttttaactcccaaatgtctatctctcatgcaatctactctgaatcttcaagcctgaaatttctgaaacatcttggatatcttctcatttttatcttggtttttgccaattcgctgtaagtacagcctggattcatcttgcactcgaaacctcttctttgttttgttagttcatataactgatttactgaacaagctggactttatagggaagaaattaaagcaaacatttttatttctcaac

SEQ ID NO: 83124 - DNA, 713 bp, Homo sapiens
ctgagcccgttcttggtgtttgagaatgcattcatgttttagctgttttcctttatttttatgctggtcacttcttactcttgtgctctgtgaaggtaaaacagttcatgtgtctcttctttccttagaagctttttcatcccttggaatttactttacccttcacctcagttctctgataggtttgaaatgttgtgattttgtagttttttttttttttcctggccttttcttgtgaggaaagaagtgatattttcttgtggatttatacatcttaagttgaatcagaacctgtcccaggatttaaacagttcatggagagtattgccttttactaaaatagtttcttggctttcatggacttagaatttatagtatttactgtgtgtggtctattgcaaaacaagttcaataatttctaattggaattttagtgttaaagtggtctgacttatatagtggatctagcccaatcttaactagtttgtaaacctagctaaatcttttaatgtctgcatctcaaccagtctttattgttttccgctatttttcacatatgcaatttacaggggagagggatgtttgtgatgctggaaattatatgctgtagtgacgtgaataaatttagctatttgcaaagatcacaggtaatattattaacagatgtcaagagtctattctattctattctttttagaatatatagtagacta

SEQ ID NO: 83125 - DNA, 321 bp, Homo sapiens
aacttttcaaataggcccagggcactcccaaacattttttaaataccaggtaagaaccctgacccacaccctccctcataacttggaatctaggccattcgcacattgatgggaacgaaacaggcatgcaggaactaaatgggaagactcttaaagcactgcctccttgcatcgaggcccttgaaacacattaaacaaagcagaaaggagccaaaagattgctgggttttagtcctaggtcaaagtcagctgtgggtacccagacccctaaaggcatgatgaacggtgctgggctgaaacaaagtccttctgcagaacact

SEQ ID NO: 83126 - DNA, 577 bp, Homo sapiens
tggagagcaaggttgtgtgtgtgtgtgtgtgtgtgtgtgtgtgtgtgtgtgtgtgtttaatgacactttcccttcctgagaggcatcttttaaatccagtctcttgatttgtgccaaatagaaacccaaaaaagacctttaatcctttgtccattggatgtgatgactttatatgtaagtgtagcttcagtttattttggaatagtgaccttttttttaatatactgttttatgagaggaaataaactccttccagaattttctcacttaaaataacttcacatcttaattacgaataggataaatatctattgtgaactacatgagaaagctgacccaactcgaataacctctacctggtatcctttctgcaacaatccaaataagttaaaagagtttttgtttagataagctgtaaaaatgataaatctatctttggtcctcagttgaaactaccaccactcatttgattgtgattctcattcttagccaaagaatatcaaaaccaaatgtgaagcttttcatacttacagatgcctgggcccccatccctggtggttttgggtctggcatagtc

SEQ ID NO: 83127 - DNA, 887 bp, Homo sapiens
ttgtacttttagtagagacggggtttctccatgttggtcaggctggtcttgaactcccgacgtcaggtgatccacccgcctcgacctcccaaagtgctgggattacaggcgtgacacccccgcctggcccatagcaaagctttattcacttaacgagtcatggccaacagcgtctggttagctcacagaggccacagttttatctgtggagtctggtaaccacgccactcacgaccctgtacattgattagatgcagcaggtcatctcaaacacacagctctctccaacaccccttagaatacaacacttgggtggtgattttacttaacattctggtacttcatcccaaaaagacatcggtagagattagtgtaactcaacaacaggcagaaaacatacaagaaagtttaagacggatgtctagcagtgcctgaactgttaagaagcaaacgtgagtaaatgccttagtttcaatagaaaaagaaagttcacagtgggacctcagaagcagaggctgtgagatcacctttcaagaattggaggagaattgcagtaagtgatagagccggacgctgagctgcagcagcctctgggaattggcggggctgtggcttgtcctgtcctgccgccccccgcgtggcctcggaaactgtcagatggtgcctaaggcagagtcgggcaaagaaagaaccagcgttcgtttcctcctggactctctaggtccatggagctggtgggggaacggccctgtcttgcccgaggaggaaattcgagtcgagcccccactcctctccccgcgggactgataaacatgtccctcattcgccccgggaggctggcacccaggcacgacgcgaggacggccagactcgccgacggcggccgc

SEQ ID NO: 83128 - DNA, 579 bp, Homo sapiens
aggaactggggggaagaggctgcagggctccgggcctttaggatgtttagattccattgtatcttagcctcgttttaacctaccttgtatcattctgtctcatcaatcataatttaaatatttgttttctctacatctctttgatcttttctgtaaattgtggtctttgacagaattttatgtgaaaagaatgctgacagtggcattcgaattttttaaaaaattctctctgattaacacatttctcttttgtggctgaaccactcatcataggaggattgttcactggtcctttgctttcaacagctcttaagatcatttgtggattgtgtaactggagaattgtgtttgggagggtttcggcttcctggccacaaggcatcttctctcccatcttgcagtaagttgaccgtctttgcgctggacgatctgcaggcctggtggtctgagaggtaccttgctctcttagttatagtgcctctttctgcgtgtgtcacgagaaagtgttcagaagaaccaatgtattttcccaagaaaaagaaatcaggaacctggtgtattttgcctgatgctttaggt

SEQ ID NO: 83129 - DNA, 362 bp, Homo sapiens
caagtcacggggagcatgttaaatgtcaaagaaactatgtaaactggtagatgttaattaactctgccagacaaaacagttgcaggattggataaatgaggaaatccatcatctaagaagttatatgcaagaacggaagggatgagaagtcattctcatacacaaaacttctcaattctcctgtgtctggatgaaggccatagacattttatgaatttaaagtgggagcaccaaaaatgtcattggagtgcttatttcttcaagcttggtgtgttataaatgtcatctagggacgatgccataccagtaggaagatatcatttacagcgtgttctagacactgaaaccatttcagtcacaga

SEQ ID NO: 83130 - DNA, 399 bp, Homo sapiens
ttatttttttgaactaggggcttgctttgttgcctaggctggtctccaactcttccgttcaagtgatcctcccacttcagcttcctgagtaactgggattataggagaacgtgcccagttaaggaccagctctttgaatagcaaaggacaagcttatcatagttgtgatttagaatttaaaacctcagataaactatggttataggtaatatatttatactaactttaaaaaatatcaaattttattattattattttttggatttaaaaaatgtttctggccaggcgtggtggctctcacctgtaatcccagcagttctggggaggccaaggtgggaggatcgcttcagtccaggagttcaacatcagcctgggcaacatagcaggactgtgtgtcta

SEQ ID NO: 83131 - DNA, 332 bp, Homo sapiens
  misc_feature (26)..(26): n is a, c, g, or t
  misc_feature (211)..(211): n is a, c, g, or t
  misc_feature (247)..(247): n is a, c, g, or t
aatctgaaatccaaaatatctgtttnattctgctgttatccatcatttatcaattcaaaaatgtttaacaaaaaaaagtagggctcttctcttccccactgtcaaaacaatgtgaatcaaaatggctaaaagaaactcctagtgttccctattgacacaaacacacacttaaggctcttataatacattctgcccagatcccaagattttngagcttcctttagctacctcctagcaacagctactngatcacttctttaaaacctcagcttttctaacgagcctctaaaatgactttcagcctcctcagaaaaacacaggtttctcaattc

SEQ ID NO: 83132 - DNA, 941 bp, Homo sapiens
cccctgcccgctgcacaccagctgtgccatttgggaggaatgggttccatactcggtgttggcattcttcacagcgccaagcactgagcgagttgggtctggaacttacatggaattttctgtaattggtacagaatttaaatgagaggcttccccaacaagggcatggctggtggtttcaggggctacccagataccaaggaggggaaaggccatttagagtgacagatgtggtgggggtggggcttctggtgaccttggttggggctgtgcttgagtgagaagagaggatgctgctgcttccagagggagctgttgtaggtgatggcagctttgaggatatgggaggagtggggagaggaagagggaacgaccaggtaagagggattttgatttaaacgatgggggaaaaggaagtatatttatgtagacgcatggctagatttgatcatttcttgaattagttttctctagtttcttctgctcatcagctttctctttaactcagcatctctctgaatgggcttattactcttctctcatctctagtactcccctgaaagaaaaaaattccagacaccctcctgcctctctttctgtttcttccctgttcttttctgctgtctcttgtatcttagtgctttgcacagtacctgccatatgttaggtgctcaaggcatatttgttatatgagcatgatatggtagggtcttaggggcggatccctcatgaatgggcttggtgccattcgtaatggggatcggagcttcctgggtccttagatatggggaagatcctggattgtcaacaaaagaagtctgggcatcctattcagtgccctcccttcttccctggcctattactactctcttctcacctcttatctctctctctatctcatcaattcctggcctgtgaacctttgaatataccaggttccc

SEQ ID NO: 83133 - DNA, 191 bp, Homo sapiens
ttttcctgattgtctttgtaataaaaactgagaggatattcgtcatccctggctgagctgcactgaattctactcttttatacatgtaataaaacagcaaacaacatcaaaatacattattaattaggcatgaatttcttaaaatggtttacatcatctcatttaacttcagagcttgcagacattaacag

SEQ ID NO: 83134 - DNA, 672 bp, Homo sapiens
gggggttgtgaatagagcctgaggcctacagatgtgtgtgtgtgaagttaccaggtgtggttctgcagctggggcatctgcagtgtggggcaggcccagcctgtctggaagcctgggcttctcctatccaccccaggccctgcccctgcagggccacacaggacgtgctactttgggtgtttaacctgtggatggcatcaggtgacgtgggaatttacaactgtcctgttggggtcaagcaaggccatagatgccaggaaccgtgctagggtctcaagaccaggggtggttttctcttcaaaaagacaagacagcactaccattgttcccgttagagcaaggccgcctgcagagggagaggagggaaggggtttggagtggacacctggggttcagatcctgcctgggcagctccctggccagtgtgcctgtgcctgccacctcaccctcagactcagcgtctggcactggagcccacaggctgtcagtgagtttcctgttgctgccgtagtcaccaccacacacagcacacagctagtgtcttatagctctggaggtcagaggtcctcaaagatgtcagcagggctgtgttcctcctggtggcccctcggccctgtcttcccatctccagcctctgcttttgttgtcaccgcccctcctctgtccctcaca

SEQ ID NO: 83135 - DNA, 346 bp, Homo sapiens
aggctaagtgggtcagagaggctaagtgggagaggagggaaggggtttggagtggacacctggggttcagatcctgcctgggcagctccctggccagtgtgcctgtgcctgccacctcaccctcagactcagcgtctggcactggagcccacaggctgtcagtgagtttcctgttgctgccgtagtcaccaccacacacagcacacagctagtgtcttatagctctggaggtcagaggtcctcaaagatgtcagcagggctgtgttcctcctggtggcccctcggccctgtcttcccatctccagcctctgcttttgttgtcaccgcccctcctctgtccctcaca

SEQ ID NO: 83136 - DNA, 280 bp, Homo sapiens
ttatattctatttactctctaagaagacaggatctgtgtctgattcctttgtttactacagagctgagcacatggtatttaatacattatagattatgaaagttccataactatttatcaaatagatgcatgtactcatatacatcagatcgattaagaaaacacactattactgctctaatcctattgctgtgattgtctattgtttttatacttctgggttaactattgaataaaagggtaagcattcatattgatttgactccctctttcttacggg

SEQ ID NO: 83137 - DNA, 367 bp, Homo sapiens
tgtggaggccagctgtttcagtaggcagtagagaatgaaaaccttatgggagtgaattgaagagaaaattggaggctaggaagtagaggctgtgagcagtttagcaatttagatttatgaggagagtgggaggaaggtgaaatcccagtcacaggtaacagcagcctgctgcccctttaggttatataattcatggaccaggaagtgtgtttgtcacagctttttgaagtatgtgccccaggataaatttttttaaagtgaggctgggcgcggtggctcacacctgtggtccccgctgttggggaggctgaggaaggcagatcactcgaaccaggtcaggagttctaaaccagtgtggccaacgtgg

SEQ ID NO: 83138 - DNA, 736 bp, Homo sapiens
acactctacccaagtcccaaaagcaggttcacataactcctgtcttcattatctgatatccggcttgcttacattctctcgctcccgcagcttccactatagcagtgtttcttcaccctggcagcagcagttcctccctgcggttgcaactaaatccaggttgcagtttttccaacatttactataccagccttaccagcctcatcaccactcacaccagcaccctcttctccaagacatttgaagttctacaatgaacccgtcggagatgcaaagaaaagggcctccacggagtctgcaggtgtacccaacagctccgaagagacagcgaccatcaagaacaggccaagatgacgatggcagttttgtcgaaaagagaagggggaaatgtggggaaaagcaagagagatcagattgttactgtgtctgtgtagaaagaagtagacataggagactccattttcttatgtactaggagaaattcttctgccttgagattctgttaatctatgaccttacctccaaccccgtgctctctgaaacatgtgctgtgtcaactcagagttgaatggattaagggcagtgcaagatgtgctttgttaaacagatgcttgaaggcagcatgctccttaagagtcatcaccaggactttcttataagctaattaacaaatttgtacatggttaacaattgtttacattaaattctattggtaaagtaactgatgtgattttgt

SEQ ID NO: 83139 - DNA, 1062 bp, Homo sapiens
aacttggttgctagttccttgagaactgaaaccatcaattgcacttcttggtatcctccacaataaggtatctaggtactcaaatatttgttggttgattaaaaacataaaccacaagacataattaactctttttaaaattgtggtaaaaaaacatgtatttaccatcttaatcatttttaagtatactgtatattagtgtttactatatgcacattgttgtgcaacacatctctaggactttttcatccagaattctttttttttgagacagagtcttgctgtgtcgcccaagctggagttcagtggcaccatcctggctcactgcaactgctgcctcccaggttcaagtgattctcctgcctcagcctcccgagtagctgggattacatgtgcctgccaccacgcctggcaagtttttgtatttttagtagaaatggtgttttaccatgttggccaagactggcctagaactccagacctcaagtgatccacccgcctcagcagcccaaagtggtgggattacaggcatgagcaactgtgcctggcctagccattttctataaacctgaaaatagatgccagaaaagaaggtgccgctataaaatgctttcttgagtgatttatgtctaacatacaattaaacatttatgagaaggaaattatcaggttaaaatataaactcacttgccaattatttgattttcaggatatctgacttttgttaattactgaaaataaagtattatttctaatcacaaaaaaaaaaaaaaaaaaaaaaaaaaaaaaaaaaaaaaaaaaaaaaaaaaaaaaaaaaaaaaagaaaaaaaaaaaaaaaaaaaagaaaaaaaaaaagaaaacacagacaaacagacgaacagaacaaaaaacagaaaagaataagaacgaaaagatagcaacaaacaacaaagaaaataaacgacaagagaacactaaagaacgtaagagctatgacacacaagagtagagacacgagtgaagtgagacaaatgacaacagagcatcaaagagatacgagacgaggaaaatcaataaaaagaa

SEQ ID NO: 83140 - DNA, 396 bp, Homo sapiens
cacaccaccaagtgtgaggccgactccagcgtcccacccccagggctccccctcgcagccccagatgaccctgtcattcctggcagtggctggggcacctgtgttgcgacgaggagttcccagacccctgaggctgtctgtggcctgcagagcccccagggcgccgaggtctgacctgcagcgcctgaggtctgactgtctctgcctgcagcatgccggcccctctcctgcagcccctgcccctcacctgcctgggacctgccccgcctccgcatgcatgtggatagacccccacgggccgtggccaacgcttgtccctggggccacacagggacactggaggtcacagttatttattgatcacaattgtggacattaaaacagaaactgttcaca

SEQ ID NO: 83141 - DNA, 241 bp, Homo sapiens
agctgagattgcagcgctgcgctccagcctgggtgacagaatgagaccctgtctcaaaaaagtaaagttggaattttgtttgtgaacacgcgtgtcagaaagatttcagtttgtgaatgatcgtgaagtggtggaagggagggtcctctgatgtggaaggacagttgtgacaccaaatgtggatggatggagcctgtaacaatggtgtgagctgaggcagccaggagattcttgagagggt

SEQ ID NO: 83142 - DNA, 112 bp, Homo sapiens
ggcgagtccgcagtgcaaagtaaaagcaagtttgttgagaaagtaaagttgtgaaacagctaccccatagacagtaggacgttcctgaaagtaagaggaacgtatgcaccct

SEQ ID NO: 83143 - DNA, 246 bp, Homo sapiens
  misc_feature (27)..(27): n is a, c, g, or t
  misc_feature (29)..(29): n is a, c, g, or t
  misc_feature (31)..(31): n is a, c, g, or t
agttctgaaaggaaaccagagagcacnangngtctagtttttagctgtatgtaggttttatatgtgtgtaatgttcagacctgtgtttcataaaatcattaatttaactcgagatggatttttgtaggaaagtagaaagataattaaggaggaagcaaatcttttcatgagaaagtgtaggataggtttcacagcgttgtcctgagaaggagaattgcttgatattggaatagattgcggtgtttg

SEQ ID NO: 83144 - DNA, 2303 bp, Homo sapiens
caccagtctttgttgagtcccttcattggtgctgaaaccaggctcttgggaaccttattggcagtgtttaattcttttgtaatttatgtctgtttgaaatctgtctgtccagcttgggttacttgaagatgctttgaatctggaatggctcttactgcatatcatggggcagctttgagtacctggtagtctcagaattttggtaagttccgagactgctgttggtatactgaggaagatctgtattcactgattacacaagccaggagcgacaacgaggattaacgtggttacctagtatgcatgcctttctggtgtattgattttccagaatatttctcaaatttcatatacctatgagccttattcttgggataaattgatttatactgctagactccttgcaattgaaacagtaccacttctgagcactcaccctgagcacagataaccatagctggagtaacctggattagtaaggacacgttttctttcatctgtacacctttgaattagtaaaccaaagattaaaacactaattttaaaaaactttttagctttttaatgggctaggtgtatgaaattgtatgaaacaaagtaagtttataattgtttcccaggttttgttgagggagtggcttgcttataactcttaggagaagtaaatcctttgtgttccctcaagtcacagcccttggatacagcatccagggcctttctgatatgcacacctctcttggtgcctcagtcacctttcttttccttggtgccaaatatgtgcccagttgaggaatttcgtacagtcacatgcctcatgctatcattttggttaaggatggactgcatgtatgatagtggtcccataagatcatagtgtcatatttatactgtaccttttctgtgtttagatacacaaacactttgtgttacaattgtctacagtattcggtacagtacgtgctgtacagttttgtagcctgggaacaataggatgttgcatacagtctaggtttgtggcaggctataccttctaagtttgcctgggcacactgcaatgttcccacagtggtaaaatttcctaatggcacatttcaacatgtatttccacacattcctcagaatgtatcgctgttgttaagcaacacatgactgaacttgcagttccctacccgaaacacacgtgtaacttacatagccacatccctgatttccttcagggtctgttcacatgttatcagtgagtccttttgccaaagtattatgaatagtccccacccccacttttccctaatgtgctccctgttctgtgtcttccccgtactatctgtccccatccaatatactctaaatagttcatgtttcttattttttaagtttctctctcccccggaaggtaggtgtgttgttttcatttactgtagaataatgccttgaattaataggtgctaaatatttgttgaacgattaaatacaacatacaatttagtaagtttacaactactgcatatttatggaaagaaatatattgattctttctcattatgggcagcagtgaataaagtaagctaatcctgggcttgggtatttgtgtcactcatatttgctatgagtggttgatttaaagtgctgatttcatttgcatttcatagcttcatctaattttaattaaaattggaggggcaattatatagtgattaaatgcaaatgttttataatttccaaatttatctgattaacctaaagaactaaaaccaaggtatgttttaagggaattaatgtgttttccaaatcatgttgtggccattgctgtggactggcagtatctattcaccatacataatgactggaaggcggctgtggacaccctgttcctcttggcagcacaggaatggaagtgggtcccagtcctgatgattaacactgaaaagggagactgctggtagcttctggaaaaaatttcctcaagcctaagaaagaagcagagcaagagatgctccttttgcttctggacatcgccttgtctgaaaaagaagcttgcagctggggagctctgattgccagcctgagggtgaagcttgacctgcgatgcagtcagccgcctccgcacttcttgtttagttagatgataaatttccttcctacccaaccattataagctggcagtttggtaactgcagccccaggaacatcgaaaccgacacatctcatgtcataacctaattttgaatatttatttcattgctacttcattgccacttgtacctcataataaatccatttttgaaaaccttaaaaaaaaaaag

SEQ ID NO: 83145 - DNA, 2249 bp, Homo sapiens
caccagtctttgttgagtcccttcattggtgctgaaaccaggctcttgggaaccttattggcagtgtttaattcttttgtaatttatgtctgtttgaaatctgtctgtccagcttgggttacttgaagatgctttgaatctggaatggctcttactgcatatcatggggcagctttgagtacctggtagtctcagaattttggtaagttccgagactgctgttggtatactgaggaagatctgtattcactgattacacaagccaggagcgacaacgaggattaacgtggttacctagtatgcatgcctttctggtgtattgattttccagaatatttctcaaatttcatatacctatgagccttattcttgggataaattgatttatactgctagactccttgcaattgaaacagtaccacttctgagcactcaccctgagcacagataaccatagctggagtaacctggattagtaaggacacgttttctttcatctgtacacctttgaattagtaaaccaaagattaaaacactaattttaaaaaactttttagctttttaatgggctaggtgtatgaaattgtatgaaacaaagtaagtttataattgtttcccaggttttgttgagggagtggcttgcttataactcttaggagaagtaaatcctttgtgttccctcaagtcacagcccttggatacagcatccagggcctttctgatatgcacacctctcttggtgcctcagtcacctttcttttccttggtgccaaatatgtgcccagttgaggaatttcgtacagtcacatgcctcatgctatcattttggttaaggatggactgcatgtatgatagtggtcccataagatcatagtgtcatatttatactgtaccttttctgtgtttagatacacaaacactttgtgttacaattgtctacagtattcggtacagtacgtgctgtacagttttgtagcctgggaacaataggatgttgcatacagtctaggtttgtggcaggctataccttctaagtttgcctgggcacactgcaatgttcccacagtggtatcgctgttgttaagcaacacatgactgaacttgcagttccctacccgaaacacacgtgtaacttacatagccacatccctgatttccttcagggtctgttcacatgttatcagtgagtccttttgccaaagtattatgaatagtccccacccccacttttccctaatgtgctccctgttctgtgtcttccccgtactatctgtccccatccaatatactctaaatagttcatgtttcttattttttaagtttctctctcccccggaaggtaggtgtgttgttttcatttactgtagaataatgccttgaattaataggtgctaaatatttgttgaacgattaaatacaacatacaatttagtaagtttacaactactgcatatttatggaaagaaatatattgattctttctcattatgggcagcagtgaataaagtaagctaatcctgggcttgggtatttgtgtcactcatatttgctatgagtggttgatttaaagtgctgatttcatttgcatttcatagcttcatctaattttaattaaaattggaggggcaattatatagtgattaaatgcaaatgttttataatttccaaatttatctgattaacctaaagaactaaaaccaaggtatgttttaagggaattaatgtgttttccaaatcatgttgtggccattgctgtggactggcagtatctattcaccatacataatgactggaaggcggctgtggacaccctgttcctcttggcagcacaggaatggaagtgggtcccagtcctgatgattaacactgaaaagggagactgctggtagcttctggaaaaaatttcctcaagcctaagaaagaagcagagcaagagatgctccttttgcttctggacatcgccttgtctgaaaaagaagcttgcagctggggagctctgattgccagcctgagggtgaagcttgacctgcgatgcagtcagccgcctccgcacttcttgtttagttagatgataaatttccttcctacccaaccattataagctggcagtttggtaactgcagccccaggaacatcgaaaccgacacatctcatgtcataacctaattttgaatatttatttcattgctacttcattgccacttgtacctcataataaatccatttttgaaaaccttaaaaaaaaaaag

SEQ ID NO: 83146 - DNA, 483 bp, Homo sapiens
ttccttataatttatttgctgaagaagtcagttcttttgtctggattttgctgattttatcttggttttcttgcttatcttacataaaaactgaaagctctatcttaaccaactaggttcttagccttggccagacattacactcacctgggaagcttgtaaaatcctgacatgtgtggaaagcagcttgtcacttcctcaataagttaaacatagaattaccatatgacccagcaatttcactccaaaagaatggaaacaggttcagacacagtcttgtattcgtatgttcacagcagcactattttcaatagccaaaagatggaaacaacccaaatatccttcagctgaggaaagggtcaacaatatgtggtatttccacgcaatggaatattattcatccttagaagtcacaaagtactcatgcgtgtttacaacctggatgaaccttgaaaacactgcggtaaatgaaagaagcctgac

SEQ ID NO: 83147 - DNA, 1039 bp, Homo sapiens
ctctctgccccttaataaatgtttttggtactgactactgctgctcctgctaataccatcctgtagaaatttttcttgagtgaggaatagtttttagaaggcttttatgatgataacttttaaatttatttttaactatgccagcaggttattagatatataggttcaaaggagattgaggctggagtctgttcaaacattttcagaggtgaagatgacacagggttcatggagatttccttcatggtaccagaacagggcagggtttcactgcatgataatacccatgtttccattgcttgtagacctaatcatttttacttattgattggcactgtgggccaagatcgtgacatccatcctaataagcaggtctcatcaaaagccttagaatggagaaaattttaataatgctttattagttggttaagtaagccctgatgtttggctttctagtgaccggtcattgccctgcagactctgtaatgggacagtttggctgggtgtagggggtcatgccaggctgaggtgggaggattactgtaggccaggagttttgagactagcctaggcaacatagaccgccccccatccctataaatatttaacaattagctgagcataatggtgtgtgtgcttgtagtcttagctgctgaggaggctgaggtgagaggatcacttcagctcaagagcttgaggttacagtgagctatatgattgcaccagtgaactccagcctgggcaacacagtgagaccctgtctcaaaacaaaaacaaaaacaaaaacaggtagggagagacaaggagaagggtagtactgacatggcctgtctttactttcccctctcagccctggaactctccacagggaaaggttttttgttccttcttcttgtctaataaatggcttgacttgaggggtatcttggaggcattctcaacccaaccctgaaggtttatcagcactttcctggtggacagcacctcagcctctgccctggctcctttcatcctcatcccctagagccaggatcccagc

SEQ ID NO: 83148 - DNA, 454 bp, Homo sapiens
ttgatagtaaaagaatcaaaatagactattcagcattgctgctcctaactcaggtaaaacaggagaaatgttgctgtgtgtgtattaaactcaaaaaaacaacatgaaatctgagatggcatgagagatgaaaggcaacatgcttaagtggtctttaagataagacaaagaaaagacttcagctactactcaatagcaaacccatcaggctgcttctgaaagacaggagtcccaagtattatatgaaattaccatgaaaaaagtaactcctaaataagacattgtatacttaaatatatttgtgaaaaatgcaactgtttttcccttctaacaaactggggaaaaaatactttcatcaaattttccctgaatgagccaggagcagtggctcatacctgtaatcccagcactttgggaggctgaggcaggcagatcacctgaggtcacgagttgg

SEQ ID NO: 83149 - DNA, 405 bp, Homo sapiens
caaaaaaaaaaaattttttttttcttcaaacaaccctgctaagaggatgaagaccagctaccaactaagtgaaaatatttgcaagccacatatgtagcaaaggagtcagatcaaggttataggaagaaactcaatattaaagaaataatccagttagaaaataggcaaaagatatgtagagacatttcacctaaggggatattcagatgactaatgagcacctgaaacgatgtccagtatcactagccattaaggaaatgcaaatgaagaccacaatagtataccagtatacatctattagaacagctgaaataaaaaatagtggcaatagtaaatacggctgaggctgtgaagaaactgtatttctcccatatttgtttgaaatgtgaattggtacagtcgttc

SEQ ID NO: 83150 - DNA, 783 bp, Homo sapiens
tggctcatacctgtaatcccagctagtcgggaggctggggcaggaaaatcatctgagcctgggaggtggaggttgcagtgaaccgagatcgcgccattgcactccagcctgggcaacaagagcaaaactccatctcaaaaaaaaaaagataagaaagaaaatattctgattgctttcagccacaagaaaaactaatgttataaattaatatgtctcatgcagtataatcatcggaactcttgactttatgtcaacttgcctcagcgtggcctgctcaaggcagaagcatgcagtcaaggagagggtgattgtctgcttctctttttcctctgggagcctctcctccacagcccgcactttctgggacttctgaccctccaggcttggagtttctctgaacatgttaaatgatttgagctgatgcttctctcctggttactccgatgggctggccaggaagctgtctgactgctcctcttcacttggagttgggggatggactctgctttggtttgtcattcatcacccttggcaaccttagcatggggtggccgtctccacacggactgtctctctgttgtgtcccatcgtactctcaggcagtcctcttgggcaagatctctttttctcttttttaaagacagggtcttgctatgttgcctaagttggagtgcagtggctattcataggcgtgatcatagctcgctgcagcctccaactcctgggctcaagtaatcctcccgcctcagcctcccaagtagctgggactatagtcacacccca

SEQ ID NO: 83151 - DNA, 233 bp, Homo sapiens
cagaatcagcccaaatgcccatcaatcaactgtgcataaagaaactgtgatatatatatatcatagaagttcaaacagaaaaaatacaaaaaacttagcagaggattgtatcctttgccgtttattttgatgaccatgccatcttctaatccccagaaaaaaactggaaaacagaataaatataattttctgattattcttatgtaacataaatggaatatatatatatatat

SEQ ID NO: 83152 - DNA, 342 bp, Homo sapiens
atttatgaggatcagatgaagacacacttgaaaagctcccagcacagtagctggagtgtgtcaagcttttcgtattttctctcctcaactgtgctttcttaagaaagctgcaaaatagtctgggcacagtggctgacacctgtaatcctggcactttgggaggctgaggtgggagaacagcttaaagccaggagttcaagaccagcctgggcaacaaagcgagaccctgtctgtaccagaaaacaaaaataaaattagttgggcatggtggtacatgcctgcagtcccagctactcggaaggctgtggtgagctgtgatggcaccactgtaatccagcctgg

SEQ ID NO: 83153 - DNA, 521 bp, Homo sapiens
tttgcctggcatctccactttgcctggcaccttctgctcctccaagatccagctccaatggcccctcccctggaaaccctttcccgaccacgccaaactcaaaaaagtctctcctgggctcccaccgtctccgcacacccatgcccatcaacgtccatcctcccatctgacccgggctccttgagggcacggcccaggcctgactcatcttggtcaccagcatcgcccagcacgaggcttggcacaccagaagcctcaggaaatgtttgtctaactaataggtgggagagtgtgtgagtgagtggctagacgagggaatccgtgagtgagagaattgagggcaggaagggcagaacggatgaaggaacaggaaggcaggagcagacgagaatcaggcttagggtgggaggaacggatggatgaataacagatccagtatcccggtctcagtttctccaagaaagcaagatgggttcgccgggactgagctcctcccccctccgcctcaagcctcactaagc

SEQ ID NO: 83154 - DNA, 382 bp, Homo sapiens
gccttgctgatcacatttaataatatccttagcatttaaatgcaaatctaaaaatttaaaagtgtttacactctttgcatttgcaaaatatctgaattaagtaaatttcattaagacgtgtcttactatattatctaattattcgggtcacttatttattagtgtatagcattacttaatgttgtctttctcagtggtgacatagtatggtaataacaatcatcaaacatctttagttgacaagaatttgaaatggatagtggggccaggcgcagtggctcatgctgtaatcccagcaataagtgaggcctagatgagcaaatcactggagcccagaagttcgagaccagcctgagcaacatgacgaaaccccgtctctaca

SEQ ID NO: 83155 - DNA, 330 bp, Homo sapiens
aggcaaaagaagtaaaatagctatcctatgctcaaagaaagagaatatttatctcttctcacaaatgttaattcacactgattcactctcctggaaatgaagaagaatggatagaaaaagtaccgataaattggctgtattttgttttacacacacaccatattatacacctctgtagttgctttcctgtcatctctcctaagggggtgaattctttagtaagaatgtcttcttactaaaattggccataagtgtttgtaaaaaatatatttttgatccagaataaattgatttcagcatccagtggtatcctacacattatatatactt

SEQ ID NO: 83156 - DNA, 570 bp, Homo sapiens
atcagacagagaaacttataagtatgttaatatttgtcaaattgcaattaaagtactggtcttcatcacttagaagcaaaattatcttctgaagaagttgattcagaaggagtgaattttaactagctagaaacaatgtattattatgtatcagcacctggaaataataatgtttttcataggcctccccattactggaaactaaacaatgatgaataatttgaattaaatatttagagaggctaatttttacttaataggaataaccagaggagtcaacaattttttttttttttgatggagtttcattcttgttgccaaggctggagtacaatggcgtgatcttggctcaccacaacctctgcctcctgggttcaagcgattctcctgcctcagcctcccgagtagctgggattacaggcatgcaccaccacgccaggctaattttttgtatttttagtagcgatggggtttctccatgttagtcaggctgatcttggaactcccgaccttaggtgatctgcctgccttggcctccctaagtgctgggattacaggcgtgagccacca

SEQ ID NO: 83157 - DNA, 539 bp, Homo sapiens
aatgatgagcctaaaataaccaggttacaaggaagtactacgcctttagaaccattctgtatccattgatggaaggacaactttcttgggcactaaaacttctcaaccagaagatctcagttacaggggcaggaaacaaagctttcacaagtagctcattggacataaccataagagacatcatcttcatggtggctttgtattctgtgtattgaggctgtaacaatgtcagtcaagatgtgagtagccagagagagaagaccaggaatagctgtcctcttactgaatggtgcttaactgaggttgatatatcatatattacactcaccaaagtcatgcttagactgcctcctgaaaaaagctgaaccaatttctaagatgacaggctttaggcataaattatctttcctatacgtgttcaaaagggagaattttttaggagcaaaacacgtaaaactttttttggtaaaaacaacttggtttcagcactactatacatttcatcatttcccctggctcatccattaaatctccctatg

SEQ ID NO: 83158 - DNA, 394 bp, Homo sapiens
gctcttaagatttaacctgaaagactgattcaggccacaaagggaagtgggggtcagacatgccttattatacctctctggcattaacatcaacacagattttaagtctaataagaaacattttacagcctgttctctctgaaacctgttagccaaagcttcatctgcatgataaaactttggtctctacaacctcttgcatcccaaacattcctttctattgatcccaggtctttagacaaactcaaccaattgtcaaccagaaaatgtttagatttacctgtaggctggaagcccatgctttgagttatcccacctttctggactttctggttctacaaatcactgcacctggcctcattttcttatttaatttgaccttttgacttgaact

SEQ ID NO: 83159 - DNA, 362 bp, Homo sapiens
catgtcatagtggcctgctctcctaacacagcacaatttagggcatattttcatgatggtctatcactggattacaacacatctcttcattaaagtcttgggaaagaggcttcaacttttctgtgttgagaaaacttcacaggtgtgtaaagtttgatcagtatgtataatatatttgattacatatattttatttttatttttcatttttttgcatacatagcaggtgtatatacttatgggttatatgagatattttgataaaggcatgcaatgtgtaataatcacatcagggtaaatgcagtatctatccatcaccccaagcatttatcctttgtgttacatacagtccaattacactc

SEQ ID NO: 83160 - DNA, 758 bp, Homo sapiens
ggtagatggtgtcagaattaaattggaggacacccagctggtgcatggtgtgtgggcacagaagtcttctgtgttgaccgttcgggtgtgagagcagaggataggcagggtttcagagattttatgaaataggtgggaataacactttctgagacttggtttccccatctgtaaaaaaggaagtagtaatagtacccacttgggagagttctgtgaggactcaaatgacacgaggactcaaaaagctgggtacggtgtctggcccatcgtaaaggctgagtaattgacaggtgcatttatccctgtggttcctcactgagcccgtgataaatgggcctgtggcaggacatgagtgagctgcaggaacaggagccaggcctcccaccttgccggcttggaagaccgtctggctgcagcagagacattcttcccagaaagaaggggctttccatggtgaaccactgtggccaggcccagaggcctttacaatgccaatgtcccaagaagagaggggccatcagaaggatggaaattttctatgtgcttccagaaatcaacctacagattgatcccttctcaaaagactaatttttattctagtcatgcccagctataagcatttgggcatttacagataatctttgttcctgaagggcatccgagtatgtccttcctccttttaatgcccatgacccttactatcctggaacagagtccacattgcagaaaggacaaggctcaccacgttcagggcccca

SEQ ID NO: 83161 - DNA, 392 bp, Homo sapiens
ggtagatggtgtcagaattaaattggaggacacccagctggtgcatggtgtgtgggcacagaagtcttctgtgttgaccgttcgggtgtgagagcagaggataggcagggtttcagagattttatgaaataggtgggaataacactttctgagacttggtttccccatctgtaaaaaaggaagtagtaatagtacccacttgggagagttctgtgaggactcaaatgacacgaggactcaaaaagctgggtacggtgtctggcccatcgtaaaggctgagtaattgacaggtgcatttatccctgtggttcctcactgagcccgtgataaattcgcgtagacagcattctgaagttggtctgggtcagatgcggccgtttatcctcaagagt

SEQ ID NO: 83162 - DNA, 174 bp, Homo sapiens
tgagtctagaatacacattactggcattttgtgtgtagaattaatgtttatggaatgaataagtgcatggataacagttgatcccacaggaacgaatgaggaggtgcttcattcagtagtagtctacaagacttgtcaggaactttgcaatgttgaaggtctgccaaggaggag

SEQ ID NO: 83163 - DNA, 3411 bp, Homo sapiens
tccaaatcatagctcacccatttattgttcttgtgtgagtccttgggcaaaatcattaatatctctgagaatccctccactcactgatcaatctggaataataatgtttccctgtggtgggtgctgtgaatatttacacaaagtaaaagcatggatttacataaagtgtcctgcaaagggcccagcacacagtaagtgattaataaatgctagttcccttcctttctcctgtcctgtttctcctcaaggctccatgcactggtccactggtctctcctcatgtcccctcctggtgccaggacactctgccagccactccttttccctgcctgctggagggccaggtgctcccgccttccaccctccgccctcctccctcccctgggccctgctccctgccctcctgggcagccagggcagccaggacggcaccaagggagctgccccatggacagggccccacagagacagcaccgagcctcacgggagctgctggctgcaaagaagacccacacctcacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttacattttctgcctctgccttcctcccagctcagcaaggaagtatttgggcaccctaccctttacctggggtctaaccaaaaatggatgggatgaggatgagaggctggagataattgttttatgggatttgggtgtgggactagggtacaatgaaggccaagagcatctcagacatagagttaaaactcaaacctcttatgtgcactttaaagatagactttaggggctggcacaaatctgatcagagacacatatccatacacaggtgaaacacatacagactcaacagcaatcatgcagttccagagacacatgaacctgacacaatctctcttatccttgaggccacagcttggaggagcctagaggcctcaggggaaagtcccaatcctgagggaccctcccaaacatttccatggtgctccagtccactgatcttgggtctggggtgatccaaataccaccccagctccagctgtcttctaccactagaagacccaagagaagcagaagtcgctcgcactggtcagtcggaaggcaagatcagatcctggaggactttcctggcctgcccgccagccctgctcttgttgtggagaaggaagcagatgtgatcacatcaccccgtcattgggcaccgctgactccagcatggaggacaccagggagcagggcctgggcctgtttccccagctgtgatcttgcccagaacctctcttggcttcataaacagctgtgaaccctcccctgaaggattaacagcaatgatgggcagtcgtggagttgggggggttgggggtgggattgtgtcctctaaggggacgggttcatctgagtaaacataaaccccaacttgtgccattctttataaaatgattttaaaggcaaaaaaag

SEQ ID NO: 83164 - DNA, 3334 bp, Homo sapiens
tccaaatcatagctcacccatttattgttcttgtgtgagtccttgggcaaaatcattaatatctctgagaatccctccactcactgatcaatctggaataataatgtttccctgtggtgggtgctgtgaatatttacacaaagtaaaagcatggatttacataaagtgtcctgcaaagggcccagcacacagtaagtgattaataaatgctagttcccttcctttctcctgtcctgtttctcctcaaggctccatgcactggtccactggtctctcctcatgtcccctcctggtgccaggacactctgccagccactccttttccctgcctgctggagggccaggtgctcccgccttccaccctccgccctcctccctcccctgggccctgctccctgccctcctgggcagccagggcagccaggacggcaccaagggagctgccccatggacagggccccacagagacagcaccgagcctcacgggagctgctggctgcaaagaagacccacacctcacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttacattttctgcctctgccttcctcccagctcagcaaggaagtatttgggcaccctaccctttacctggggtctaaccaaaaatggatgggatgaggatgagaggctggagataattgttttatgggatttgggtgtgggactagggtacaatgaaggccaagagcatctcagacatagagttaaaactcaaacctcttatgtgcactttaaagatagactttaggggctggcacaaatctgatcagagacacatatccatacacaggtgaaacacatacagactcaacagcaatcatgcagttccagagacacatgaacctgacacaatctctcttatccttgaggccacagcttggaggagcctagaggcctcaggggaaagtcccaatcctgagggaccctcccaaacatttccatggtgctccagtccactgatcttgggtctggggtgatccaaataccaccccagctccagctgtcttctaccactagaagacccaagagaagcagaagtcgctcgcactggtcagtcggaaggcaagatcagatcctggaggactttcctggcctgcccgccagccctgctcttgttgtggagaaggaagcagatgtgatcacatcaccccgtcattgggcaccgctgactccagcatggaggacaccagggagcagggcctgggcctgtttccccagctgtgatcttgcccagaacctctcttggcttcataaacagctgtgaaccctcccctgaaggattaacagcaatgatgggcaacttgtgccattctttataaaatgattttaaaggcaaaaaaag

SEQ ID NO: 83165 - DNA, 3357 bp, Homo sapiens
tccaaatcatagctcacccatttattgttcttgtgtgagtccttgggcaaaatcattaatatctctgagaatccctccactcactgatcaatctggaataataatgtttccctgtggtgggtgctgtgaatatttacacaaagtaaaagcatggatttacataaagtgtcctgcaaagggcccagcacacagtaagtgattaataaatgctagttcccttcctttctcctgtcctgtttctcctcaaggctccatgcactggtccactggtctctcctcatgtcccctcctggtgccaggacactctgccagccactccttttccctgcctgctggagggccaggtgctcccgccttccaccctccgccctcctccctcccctgggccctgctccctgccctcctgggcagccagggcagccaggacggcaccaagggagctgccccatggacagggccccacagagacagcaccgagcctcacgggagctgctggctgcaaagaagacccacacctcacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttacattttctgcctctgccttcctcccagctcagcaaggaagtatttgggcaccctaccctttacctggggtctaaccagtgtgggactagggtacaatgaaggccaagagcatctcagacatagagttaaaactcaaacctcttatgtgcactttaaagatagactttaggggctggcacaaatctgatcagagacacatatccatacacaggtgaaacacatacagactcaacagcaatcatgcagttccagagacacatgaacctgacacaatctctcttatccttgaggccacagcttggaggagcctagaggcctcaggggaaagtcccaatcctgagggaccctcccaaacatttccatggtgctccagtccactgatcttgggtctggggtgatccaaataccaccccagctccagctgtcttctaccactagaagacccaagagaagcagaagtcgctcgcactggtcagtcggaaggcaagatcagatcctggaggactttcctggcctgcccgccagccctgctcttgttgtggagaaggaagcagatgtgatcacatcaccccgtcattgggcaccgctgactccagcatggaggacaccagggagcagggcctgggcctgtttccccagctgtgatcttgcccagaacctctcttggcttcataaacagctgtgaaccctcccctgaaggattaacagcaatgatgggcagtcgtggagttgggggggttgggggtgggattgtgtcctctaaggggacgggttcatctgagtaaacataaaccccaacttgtgccattctttataaaatgattttaaaggcaaaaaaag

SEQ ID NO: 83166 - DNA, 1583 bp, Homo sapiens
tccaaatcatagctcacccatttattgttcttgtgtgagtccttgggcaaaatcattaatatctctgagaatccctccactcactgatcaatctggaataataatgtttccctgtggtgggtgctgtgaatatttacacaaagtaaaagcatggatttacataaagtgtcctgcaaagggcccagcacacagtaagtgattaataaatgctagttcccttcctttctcctgtcctgtttctcctcaaggctccatgcactggtccactggtctctcctcatgtcccctcctggtgccaggacactctgccagccactccttttccctgcctgctggagggccaggtgctcccgccttccaccctccgccctcctccctcccctgggccctgctccctgccctcctgggcagccagggcagccaggacggcaccaagggagctgccccatggacagggccccacagagacagcaccgagcctcacgggagctgctggctgcaaagaagacccacacctcacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttagatgtgccggcgctgctgaaatgctacgtaatcctctagggtcacc

SEQ ID NO: 83167 - DNA, 546 bp, Homo sapiens
agaagttgaggaactgtcctcatgcctcctggtccctggtagtctggagaaggacaaggaatgttactttacaggctctgaagtcctcaggttgagcgggacaggtgggtttggcatttctaagcctaaactctgggccttctgagggaatgaggtgagagagcctctgaccccaccgctatgtgggtcacgctgatcgctgagcatctaagctgctccttaggtgctgatcctgtcacctcggtgcattacaggggaaaaagtctcagccacagcctctatgttctgtttgcctataggaccatgatactgttccaggcttcagaggagaagaaatgacccaatttcaagtgcgtactgggggattgagggcatcttcttgctattcctcaagcaagccaagagggttgctatctcagggttttaacacctgtttactcttcctagagtgacattatccagagagcttcctggttcatcccttacttcatctgagtctctgctcaaagtttactgcttgagaaaggtcttttgtaaccattctac

SEQ ID NO: 83168 - DNA, 395 bp, Homo sapiens
aatttaccaaatgccaattgatttttttgtgtgcattttaatctctctgtgcttccttgttggtactggagggcccagattttcaggttccccccaaccccagtccataccaaagcagaaacaaggctcacagaattggaaatggaactgaggcctcctgcctctctgtccaatgttctttctgctaataaatatctattgcttttcctgcccggcatgcattctttcttctggtaacatttttaaaaattgaggtaaacgtcatgtaatgggccaggcatagtggtcacgcctgtagtcctagcactttgcgaggctgaggcaggcagatcacttgagctcaggagtttgacaccagcttgggcaacatggggaaaccctgtctctatgaaaaa

SEQ ID NO: 83169 - DNA, 406 bp, Homo sapiens
gtgagccgagattgcaccagtgcactccagcttgggcaacagagcgagactccgtctttaaaaaaaaaaaaaaaaaaaaaaaggcaagctgtaaaacagcctcaggcagatccttcaggagccattccagaagaagacgttgttaccttaggagatgccagctccctgcctgtcattgcccctgaagactttccatgggacaaagtgtggaggtggaagacagtgatattgatgatcctgaccctgtgtaggcctaggctaatatgtatgtttgggtcttagtttttaacaatttttttttaattttagaagtagaaaaagtttataaaattaagaatataaagtatttttcatacagctgtacaatgtatttgtgttttaagctaaatgttattagaaaatagtt

SEQ ID NO: 83170 - DNA, 315 bp, Homo sapiens
ctatatttgagttgataattgctacaggaaaaaatgaaaaatcactcattatgcagattggtgtccctataaattcatggtctcaaatctcaaccagtttctcagaactgcctatcaatcttagtcgtctttgtcagttttctcattaacttaattattatctaaacctccttaagtcttcttatatcccttgtcactccccttcaacctcgccttactctcagttttctacttaaagaaaattaaagcatgacttctctcaaattatcatctttccccccttattacaaccagccctccttatatgtggattcc

SEQ ID NO: 83171 - DNA, 623 bp, Homo sapiens
ttcatttgcatttattccccattgtgcttttgcttctgtttctcttttaagtggagcaacactgtctgaagacacgttatctgtgcagagccagagaactttaaaaggaaagtttaaatgttcttagttctcctgaggtccaggtaagaagggggtggtaagaagaggatgggggacagatggctgagatcccttgggaggagatataggggagcactggaattcccccgactcccactccttgctcccttggccctctgccctccatgctggagagctgataggtagctggagtggcccagggagacctatgggaaggacccgtcctaccattagggggcttctctctatgaatgctaagaaacaaagggcatccattccaaatgagtagcagaggtgaccttctagggtttctacccatgctcagttgtatcccattccctgttcaccttttgtccccagcactgatataaaagccatatatatgttagtcaggtttgcactgagtcttcttccaatccttcagcctggacaacagagtgaggtccccttgtggccagaggccagccctccttgcctgccttcctttgacctctcttttccatccatgaagccctcaggcc

SEQ ID NO: 83172 - DNA, 431 bp, Homo sapiens
agagataggggtctcaccatgtttcccaggctggtctcgaacttctggcctcaagcaatctttccatctcatcctcccaatgtgctgggattacaggcatgagccactgcaccaagcctaggacatttttaataatcacctcccttaccccagccaaggttcccaatcctcagagaaaaagctgttcaagacaaaccttcctaagcagacccagaggaacagacacggtcatgggccagcacagagcactgggcgtccctaagggcagtgactacggtgattccccggtctctgagcccccttctgccttggtgttcatggcacagccggtgaacccagattctcggcggggcatctgaccttcgaccctgtgtaatgtttagggggcccgggtacaggggacggaaagtgtgggcttaacccgggggggc

SEQ ID NO: 83173 - DNA, 520 bp, Homo sapiens
agtctgtttctttaattggagtgagtggcacttggcacacccacacagccaccttaaacattgtgggaaatcaagtccaagtatctcaagtaacagtacaacaatccatatcaggaaaaacagcttagggcttgacttcattatggttttggctgccattttatgcattctgagtagaagaaacattcctcctagcgcccccaccttgtctttaacattccgcagtggaagttcctcaaagctctccgttttgaaagcatcctctatgattaccagccactaaattgcatctgccaccgagggcccaatgggctttgaacctgttattcttgggaaattcaagctgcgagggagagagagaacgttgtacacgtgtgcagctgtgctttggagtacaagaagtaatcgtatgtgtctgtgtgttttttatgggggtaggggaagggtatattaattaacccaactgagaaggagatgactgtgttccaggaaggagccaatgaaatgagtttgctttaaa

SEQ ID NO: 83174 - DNA, 775 bp, Homo sapiens
tcttaagaagaaatgctctactcaaaaccatgcctggtttatgtaatgtggctttctttctcctgagctgggggttgcactagctgttacctgggacacaaatagtatggatggaatgctataaatcggaagtatgggtttttggacatcttgcttagatttgagctttcacccttaaactttgtatttttctttggacggaagtattggataaaggtaccagaaaatcagtgcgttgaatttgaactgtatctttttgggggaaggggcaggtgtgtctttctctcaatactatgtttacttttggctctcgtataccaaaaggaagggaggatgctaaagtctaatagttggcaaatagctgtctttcctgctgtgggtggcactgagaaggatgagacctaatcctaacttcgtaaacttttcatcttataggaaggtgaagtacatagattatggacagtgcaggctgtttatgaagataaatgttttcatcttaacagtactttgagcactgtgtgctgggctaatgagaaacacaagacagccaggtgcttatctataagagctgtctcagaaaaggtggttcagagccaacttgtgagggaaaccctgctcccactcctgggctcagttttgccttcattttctttccagtcaacagttcccaccatttacctcttagcacactacccttaacacacaccaagctatttttttttttagtaatgtttcattatggaaattttcaaagtaaacagagagtagaataatg

SEQ ID NO: 83175 - DNA, 3292 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83176 - DNA, 2819 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggca

SEQ ID NO: 83177 - DNA, 1759 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactctta

SEQ ID NO: 83178 - DNA, 3254 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83179 - DNA, 1640 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggactggctacgatatgatccatgagtacgcacccgagca

SEQ ID NO: 83180 - DNA, 3391 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacatataagaaagaaaaagtcaacaataatacatgtgttgcttgagctaagacataggagaacagacaacacatacccattacatttctaggaaatacgagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83181 - DNA, 3130 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83182 - DNA, 2035 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagaggtaagcttccttgaatgtgatcacaggcctctcggcagtaacttgctgaaggctaaggaggtagtggatggtctgttatgtgggctgaggtttgttgaacatttattttttatttatttattatttattttttttgagatgaagccttgctctgtcacccaggctggagtgcagtggtgcgatctcagctcactgcaacctccgcctcccgggttcaagctttctgcctcagcctcctgagtagctgggattataggtgcccgccaccatgccctactaatttttgtatttttagtagagacagggtttcgccatgttggccaggctggtttcaaactcttgacctcaggtgatctgcctgccttggtctcccaaagtgctgggattacaggcatgagccactctgcctggccgaattttttgtatttttagtagacacggggtttcactatgctggccaggctggtctcgaactcctgacctcaggtgatccgcctggcttggtctcccaaagtgctgggattacaggcgtgagccaccacgcccagccacatagactgtttttttagcaagttgatgtccactttgaaagtggttgttttttgttatggtattctgcatgtcacatgtttgagaggcaaaagcagcattctgacgtgaaagccactttccagtaaccaagtattcttgagcacacccaagtccagaacttcatgttcttgtcagctctaatcctttcagttatttgctttttttctgattcctgt

SEQ ID NO: 83183 - DNA, 2941 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83184 - DNA, 2460 bp, Homo sapiens
actctgtctcaaaaaaaaaaaaaaaaaaaaaagattcagattatagtacgataaactactcagaaaaagtgaaagttcctaacatgaagtagcatttacaagctttgagaaataaaatggttgaacactggggcctgataaccactgcttttttaacctctgtggtttattctcttgtagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83185 - DNA, 2061 bp, Homo sapiens
cataactctcaccatggttctctgtcccattctgcagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83186 - DNA, 792 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatgtggaccagaatttccggtgttgtggtgcgaccatgtggtgaaggaagtctaggaagaaggaaggagcgctaacgatttggtggtgaagctaggaaaagattccggaaggagcggtgcatttgtgaagattccgtcc

SEQ ID NO: 83187 - DNA, 348 bp, Homo sapiens
tgacagagtcttttagataatcatctgtataccaagtaataacatgttacaagttatttaattctgtcatctagtaattttgattaagagaaactacaagtagctcaaacaattacactagtattcattgtttgaaccattagcaggaatagactactttaaggctggctgttgcttcacgtgggttacaaataactatttgctactttttcatagataaagcccctgaccttcatggaagcattagggaaaaagaaaacttaatttctttctttcttcaaagaacttttttcctttcactagatataagaaagaaaaagtcaacaataatacatgtgttgcttgagc

SEQ ID NO: 83188 - DNA, 441 bp, Homo sapiens
cccgccagccagcgcttcgcgggccctgtcggtcccggtaagcgggcctgcgcttaccggaaagaggagcgtaagatgaaagagtagaccattgggggtctgtagggggaaggggagtgggggcgtgtgtaaggggcagggtgtgtgaggaggagaggaaccccagcaaagagtagtaataataatggccaccgtcacacgataatattcgagtaatatgtgcggggactttacaaagcatctcatatgcttcattttaacttctactccaatcctccgaggtgcgtactgttatcaaacccattttacaagataggaaaaccgaggcacgaaatagattaagtggcttatgcaaggacacacgactactacgtggcctggcctggcttcgaacttagttatcttagtcctaaggcccgtaattttaactttgctttacca

SEQ ID NO: 83189 - DNA, 365 bp, Homo sapiens
ggattgattgcacctgtgaggttgaggctgtagtgagctgtgattgtgccactgccctccagcctgggtgacagagacagaccaaccctatctcaaaaaaacacaaaaagaattttgtgcccaagtttggggcttgccacataacttttataaatggaggtaaaattttatttatgaattaccaattcagcatccactgttttgtgaaaccttgtgatgagagactttttccttttccaggacacagaatttccaggtgttgtggtgcgaccaattggtgaatttcgtagttccatagattaccaatatcagcttctgcggtgcaatgttgaccttttaaaaattatccagctgggccttacatt

SEQ ID NO: 83190 - DNA, 550 bp, Homo sapiens
aataatgagcaaatgtatacctattataattaggaaatttagtttatggaggaaaatctcatttttctatctgtcacagaaatatgatctactttgcatgcttgtttgaatgttggaaagagtgaattgatctattaagttaggaaaagcatttcaaaaatacttgtactataattataaggtggtggtaatagtgtggccactacttctgtttcattattcaccagttaataaataaacaccttgttttttagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcataggtcagtcctagggaatgtgtatttctctctcactttgggctacactgaagcagggaattgaattcttagtcatttttgcagtcctagtgactgttctgttcagcagcagcagccagaagttgaattggtgcttg

SEQ ID NO: 83191 - DNA, 2528 bp, Homo sapiens
agcggagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggca

SEQ ID NO: 83192 - DNA, 3238 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83193 - DNA, 1936 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgatctgtattaactgcttggggatcctctaggtcagc

SEQ ID NO: 83194 - DNA, 3151 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtgacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83195 - DNA, 3202 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacatataagaaagaaaaagtcaacaataatacatgtgttgcttgagctaagacataggagaacagacaacacatacccattacatttctaggaaatacgagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83196 - DNA, 3178 bp, Homo sapiens
ggcgggggggtgggggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaactcgagactagttctctcaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 83197 - DNA, 502 bp, Homo sapiens
ttctggatccccgttactggcatttgttgatttagagatactcaaactccatcctgataaagctctatttaatctgggtttacttagtcgttggtttagtttgaagtgcggggagttgttttggaaagtaggttgctacttgtggtgaaaaggctttttgctgacgtccttacctggtggaatgataagagatggtttcagtagatggccaagcattggatcagatatctgtcaacctaacttgaagagaaagccatgaaagaagtgtggctaaaaactgctgggttatgcttgctcaggaaactccctgtctgggtcacttaccttttattactaacttttcactcagtcactatactggatttcccctttttcctctcagaaaattagtaagcatgtcatttcctatccacatctatgcatttcaatcagataagagctgtgaaggtaccacgtccatgttggaccatatactaaacattggcttattgcatgatgtgct

SEQ ID NO: 83198 - DNA, 907 bp, Homo sapiens
ggttgacccgggccctcctccacacccccttccttcttcgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctgatcgaagcgctgcaagaagtcttgaagaagctcaagagtaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatgaaggggcgtccattctcctccatacatccccatccctctactttccccagaggaccacaccttcctccctggagtttggcttaagcaacagataaagtttttattttcctctgaagggaaagggctcttttcctgctgtttcaaaaataaaagaacacattagatgttactgtgtgaagaataatgccttgtatggtgttgatacgtgtgtgaagtattcttattttatttgtctgacaaactcttgtgtacctttgtgtaaagaagggaagctttgtttgaaaattgtatttttgtatgtggcatggcagaatgaaaattagatctagctaatctcggtagatgtcattacaacctggaaaataaatcaccctaagtgacacaaattgaagcatgtacaaattatacataataaagtgtttttaataat

SEQ ID NO: 83199 - DNA, 831 bp, Homo sapiens
cgtggcctctaatcatccactctgttcatggaggcgtctattcgtccttcatggctaccttttgtttgttcgccagatatctcgctgactccccccttgggcccctctgttctatccacctttgtggacccgtccgcggagactccgtctcctccccgagccctggacatctactctgccgtggatgatgcctcccacgagaaggagctgatcgaagcgctgcaagaagtcttgaagaagctcaagagtaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatgaaggggcgtccattctcctccatacatccccatccctctactttccccagaggaccacaccttcctccctggagtttggcttaagcaacagataaagtttttattttcctctgaagggaaagggctcttttcctgctgtttcaaaaataaaagaacacattagatgttactgtgtgaagaataatgccttgtatggtgttgatacgtgtgtgaagtattcttattttatttgtctgacaaactcttgtgtacctttgtgtaaagaagggaagctttgtttgaaaattgtatttttgtatgtggcatggcagaatgaaaattagatctagctaatctcggtagatgtcattacaacctggaaaataaatcaccctaagtgacacaaattgaagcatgtacaaattatacataataaagtgtttttaataat

SEQ ID NO: 83200 - DNA, 1334 bp, Homo sapiens
ggttgacccgggccctcctccacacccccttccttcttcgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctggtcggtattcccctcgctctcgacccccttgagctgtcgccttgtctcttctcttgcacgcctccctcctccccccacccccactcctattcccagagtcagggcgcggggagctgagcgcaacgcccaggcacccactgccatccgaagagcgtctcgagctcacgggctcctggcagtctgttgagcgaatccctcatcccggcccctctgagcaacaggggccccagcggctcagagacccgcggtcagtacctgggacagcgtccgctaagtttccacccctcgaccattccctgtgtccgcggagtcccaccgcagagtgcgtgtgggtccggggctccttataactagggctggaagtgcgcacctgggctgggctcgcagccaaggcggcaacttcaggctccgaagcggtgtgttgcagatcgaagcgctgcaagaagtcttgaagaagctcaagagtaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatgaaggggcgtccattctcctccatacatccccatccctctactttccccagaggaccacaccttcctccctggagtttggcttaagcaacagataaagtttttattttcctctgaagggaaagggctcttttcctgctgtttcaaaaataaaagaacacattagatgttactgtgtgaagaataatgccttgtatggtgttgatacgtgtgtgaagtattcttattttatttgtctgacaaactcttgtgtacctttgtgtaaagaagggaagctttgtttgaaaattgtatttttgtatgtggcatggcagaatgaaaattagatctagctaatctcggtagatgtcattacaacctggaaaataaatcaccctaagtgacacaaattgaagcatgtacaaattatacataataaagtgtttttaataat

SEQ ID NO: 83201 - DNA, 886 bp, Homo sapiens
ggttgacccgggccctcctccacacccccttccttcttcgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctgatcgaagcgctgcaagaagtcttgaagaagctcaagagtaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatgaaggggcgtccattctcctccatacatccccatccctctactttccccagaggaccacaccttcctccctggagtttggcttaagcaacagataaagtttttattttcctctgaagggaaagggctcttttcctgctgtttcaaaaataaaagaacacattagatgttactgtgtgaagaataatgccttgtatggtgttgatacgtgtgtgaagtattcttattttatttgggtgtttatcgatgccaccattggctcacctgtgttcaggtccacacccaaaagctggactgattctgaatgttctgcttgaattttaagtaatgtttcctgaagtgcaaaacagagtcttgagcagaacttgggaataatggcatggtcagaaatgttgtgatcaagtgtggctgg

SEQ ID NO: 83202 - DNA, 1106 bp, Homo sapiens
ggttgacccgggccctcctccacacccccttccttcttcgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctgatcgaagcgctgcaagaagtcttgaagaagctcaagagtaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatgaaggggcgtccattctcctccatacatccccatccctctactttccccagaggaccacaccttcctccctggagtttggcttaagcaacagataaagtttttattttcctctgaagggaaagggctcttttcctgctgtttcaaaaataaaagaacacattagatgttactgtgtgaagaataatgccttgtatggtgttgatacgtgtgtgaagtattcttattttatttgtctgacaaactcttgtgtacctttgtgtaaagaagggaagctttgtttgaaaattgtatttttgtatgtggcatggcagaatgaaaattagatctagctaatctcggtagatgtcattacaacctggaaaataaatcaccctaagtgacacaaattgaagcatgtacaaattatacataataaagtgtttttaataatacacaaaaacacaacaaaaaaaaaaatttggggcggccttggagccggaagagttttaaaccctctgtgtggcgcgggcccctgggttatgggaactgtgcctacgggtccagaaaccgggcggaatggggggtttcacccataaacgccggggccgggttgaaaacgaggggtggggctgggtctaacgggccgggga

SEQ ID NO: 83203 - DNA, 997 bp, Homo sapiens
  misc_feature (944)..(944): n is a, c, g, or t
  misc_feature (964)..(964): n is a, c, g, or t
ggttgacccgggccctcctccacacccccttccttcttcgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctgatcgaagcgctgcaagaagtcttgaagaagctcaagagtaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatgaaggggcgtccattctcctccatacatccccatccctctactttccccagaggaccacaccttcctccctggagtttggcttaagcaacagataaagtttttattttcctctgaagggaaagggctcttttcctgctgtttcaaaaataaaagaacacattagatgttactgtgtgaagaataatgccttgtatggtgttgatacgtgtgtgaagtattcttattttatttgtctgacaaactcttgtgtacctttgtgtaaagaagggaagctttgtttgaaaattgtatttttgtatgtggcatggcagaatgaaaattagatctagctaatctcggtagatgtcattacaacctggaaaataaatcaccctaagtgacacaaattgaagcatgtacaaattatacataataaagtgtttttaataatctcgtgccgaattcggcacgaggcggccaagggtgcntgagcggcgcactggttgantgcccggtttggcccggccttctgacgagggtc

SEQ ID NO: 83204 - DNA, 3026 bp, Homo sapiens
tgaaaagggcaggtagcaaatattagaggctttgcaagctaagacaaaatgaaggacattatttaggtactcaaggaaacttttcaccaaatttttattctaaaaattgaaaactcaaaatattgagtacaatttgagattctttttttagtaatagagttctactaatgggaataatgggattttttggcaggggacgggaggtaacattttgctcaatttgggctgaaagttggtatcccctcattggaataaatagaaaatgttaatctgttaatgctgatgtgtaatgggatttcacgtatttcatctttgaaaatgtcttttcacacaaacaggtcaaggtactgctaaatactgacacatccacccatgagcatgtgattttagttaagcatattcatcacttgtaaggcatttgtaggattcatctttttggtatttgccctttagcatgtcattcattcaagatgattcatttccaacagaagattaagaggaaactttaaaagcatttaattgcagttaaatgcttttaaaatttaaaaattttctttgcactgcatcaaggtccaaaaaactgctacaggaaaatatatccactaaaaatggatttggcaatacagcgctgttttgacttctcatagcacagaaagtatataaagcagcttgacaatcttaagttttagtttttattgaaatgaatttaccatattatgttgttgtaccttgtaatttcaggtcaaattcattaagaaacattttcaagtctgtggcaaaagttaatttccaaagttactcagtgttaaaaaacagtggttgaggatggtttttctcattcagaaaaatttcaatgtcagcccagagcccaaaaaaataaaaataaatctttagcactgctaagccattgaacgcctgtgtggcaaatcaaatcaggatattcagcttctgtttctcacaaaaaaaaaaaaaatcatggaactgaagatggttaagtccacaagagcaaatgaagttaactgttgaccagttcagtaacaccaatatttcctgtgaagtacctgctgatgaataatcaagtgagtaactacaggctttaaacaacttacgttttcacaagccttaaaatttgaccaaataaactttttttctgcttcatgcatttttcccagcatcggttgcatcacatcttagtagattccacttcaggttgtactgtttatcaacttttttgaaaatattcctacttgtagttccatacaaattcttcgatcacttcaaatccagcaatggtttctcaaaaaataaagctaggcagtactgactagtaagaggcaaagaattaacagtgtcatttgatgttgtgtccaaaatcctcattcttcaaactactgttctcatcaaagggctgatgtcttaattttctctggacacatgtctttgggttggttactatcttcaagcacgatgtaattcagcattagtaaatggttttctttgcttggctaacaaataggctacttgtaaacattttggttgcagcctcatttttattacttttgtgaaattttgctgtgatgtttcatttaaattttctaattcttctgactgttgctttcccaccagttgggaatattgtgatgttagtctgatactgtcagtctattcttttaccagttatggtgacactgcattataaacacaatgtaccagcatataataaaatagtccatattccagtgtgccttgaaagtgtaacattcaaaggtacttttcttgttctgagatacagggcatgaactggtagcagaaaaagtaataaatctagcaatacacagggcattccaaatgctttcaggtaatatctgcatcaccatgattctgtagcttgccaagcggcaatgtgaaacaagacacacatacacaggttctgtagcagctactcaactttcccattatagcaaaaaagtatccatagataatatgtaaattagtgtggctgcattccaataaaaacttatagacactaaaatttgaatttcatgtaattttcagatgtcaggaaataatcttttgattatttttcccaaccatttaaaagccattttcagttcatgggccacacaaaaacaggcagcaagctgattctggctacgggccatagtttgacaacccttgctctagtagatttaacagaatatatgagcctgtaattaattaatggctcagtaacactaaaatatcagccaaatatcttacatctggaacctagactttacaaacattgagactgtctggaacaaaataaaaaagtaaaacttagacccagtaaaagtcaaaatgttcctctacaaaagttacactatacggttgctcaacctacaatgaggttacatctgaaaaaatactaagatgcatttaatgcagcaacagcatacagtcccccaatttacgatggttcaacttataaattttgactttgcaatggtgcaaaagcaatacacattcagtagaaactataaccccatctttggtcctaaggcgctcctaaacttttgatggggttacctctcaatacacccactgtaaagttgaaaaatcattaagtcgaaagtaagttagggattatctatactttttagggacagaagccagaaatgatacaagttatgagattgagcaactatgtggctaataaaaaggcaatctttatcattcctatttgaaatccagcattgatttctcaaatagttgaacagaatttaaatattagttttctcagctaacaaatcacaagcgaaaagaagcttcacttcctttttaacgaagacaaaagaagccagttagaaacttactacattgtgttagattttttaaaaagccacagttataccaaatgtatttactttgtgaagtatatccttcggaataaatgcattcctggaaaggagaaacagaagtcagtccttaattagctagttgaggtactcataaagaacaagaataagccaacacttgaaatgcag

SEQ ID NO: 83205 - DNA, 2989 bp, Homo sapiens
tgaaaagggcaggtagcaaatattagaggctttgcaagctaagacaaaatgaaggacattatttaggtactcaaggaaacttttcaccaaatttttattctaaaaattgaaaactcaaaatattgagtacaatttgagattctttttttagtaatagagttctactaatgggaataatgggattttttggcaggggacgggaggtaacattttgctcaatttgggctgaaagttggtatcccctcattggaataaatagaaaatgttaatctgttaatgctgatgtgtaatgggatttcacgtatttcatctttgaaaatgtcttttcacacaaacaggtcaaggtactgctaaatactgacacatccacccatgagcatgtgattttagttaagcatattcatcacttgtaaggcatttgtaggattcatctttttggtatttgccctttagcatgtcattcattcaagatgattcatttccaacagaagattaagaggaaactttaaaaattttctttgcactgcatcaaggtccaaaaaactgctacaggaaaatatatccactaaaaatggatttggcaatacagcgctgttttgacttctcatagcacagaaagtatataaagcagcttgacaatcttaagttttagtttttattgaaatgaatttaccatattatgttgttgtaccttgtaatttcaggtcaaattcattaagaaacattttcaagtctgtggcaaaagttaatttccaaagttactcagtgttaaaaaacagtggttgaggatggtttttctcattcagaaaaatttcaatgtcagcccagagcccaaaaaaataaaaataaatctttagcactgctaagccattgaacgcctgtgtggcaaatcaaatcaggatattcagcttctgtttctcacaaaaaaaaaaaaaatcatggaactgaagatggttaagtccacaagagcaaatgaagttaactgttgaccagttcagtaacaccaatatttcctgtgaagtacctgctgatgaataatcaagtgagtaactacaggctttaaacaacttacgttttcacaagccttaaaatttgaccaaataaactttttttctgcttcatgcatttttcccagcatcggttgcatcacatcttagtagattccacttcaggttgtactgtttatcaacttttttgaaaatattcctacttgtagttccatacaaattcttcgatcacttcaaatccagcaatggtttctcaaaaaataaagctaggcagtactgactagtaagaggcaaagaattaacagtgtcatttgatgttgtgtccaaaatcctcattcttcaaactactgttctcatcaaagggctgatgtcttaattttctctggacacatgtctttgggttggttactatcttcaagcacgatgtaattcagcattagtaaatggttttctttgcttggctaacaaataggctacttgtaaacattttggttgcagcctcatttttattacttttgtgaaattttgctgtgatgtttcatttaaattttctaattcttctgactgttgctttcccaccagttgggaatattgtgatgttagtctgatactgtcagtctattcttttaccagttatggtgacactgcattataaacacaatgtaccagcatataataaaatagtccatattccagtgtgccttgaaagtgtaacattcaaaggtacttttcttgttctgagatacagggcatgaactggtagcagaaaaagtaataaatctagcaatacacagggcattccaaatgctttcaggtaatatctgcatcaccatgattctgtagcttgccaagcggcaatgtgaaacaagacacacatacacaggttctgtagcagctactcaactttcccattatagcaaaaaagtatccatagataatatgtaaattagtgtggctgcattccaataaaaacttatagacactaaaatttgaatttcatgtaattttcagatgtcaggaaataatcttttgattatttttcccaaccatttaaaagccattttcagttcatgggccacacaaaaacaggcagcaagctgattctggctacgggccatagtttgacaacccttgctctagtagatttaacagaatatatgagcctgtaattaattaatggctcagtaacactaaaatatcagccaaatatcttacatctggaacctagactttacaaacattgagactgtctggaacaaaataaaaaagtaaaacttagacccagtaaaagtcaaaatgttcctctacaaaagttacactatacggttgctcaacctacaatgaggttacatctgaaaaaatactaagatgcatttaatgcagcaacagcatacagtcccccaatttacgatggttcaacttataaattttgactttgcaatggtgcaaaagcaatacacattcagtagaaactataaccccatctttggtcctaaggcgctcctaaacttttgatggggttacctctcaatacacccactgtaaagttgaaaaatcattaagtcgaaagtaagttagggattatctatactttttagggacagaagccagaaatgatacaagttatgagattgagcaactatgtggctaataaaaaggcaatctttatcattcctatttgaaatccagcattgatttctcaaatagttgaacagaatttaaatattagttttctcagctaacaaatcacaagcgaaaagaagcttcacttcctttttaacgaagacaaaagaagccagttagaaacttactacattgtgttagattttttaaaaagccacagttataccaaatgtatttactttgtgaagtatatccttcggaataaatgcattcctggaaaggagaaacagaagtcagtccttaattagctagttgaggtactcataaagaacaagaataagccaacacttgaaatgcag

SEQ ID NO: 83206 - DNA, 427 bp, Homo sapiens
gatggcctttgagcatggacctgatgaaaagtgaagccatgcagatatcttagaggaaaagcatcatggacagagggaagagcaaatgcagagaccctgtattagtccgttttcatactactataaagatactacccgagactgggtaatttgtagacaaaggaggtttaattgactcacagtttcacatggctggggaggcctcaggaaacttacaatcatggcagaaggtgaaagggaagaaagaaccttcttcaagtggtagcaggagagagaagagcaagccaaagaagagctgcccaacacttatcaaaccatcagatctcgtgagaactcactcgctatcacgagtacagcatggggggatctgcccccatgatctgattacctcccaccaggtctctccctcaacatctggggattacaa

SEQ ID NO: 83207 - DNA, 296 bp, Homo sapiens
aggtcaagaggtgagtgcatttacaaatttgataggtgttgccgaattactgaatgaaagggatacccactttaattcccttcagcagtatacagtagtgcatgtttacccacagcttcaccatcaagttgttttcaaacttagttttttcccctaaactgaaaggtgaaagtgattattttatattcttaacctagtttatttaccaaggaaataactctattactattgtaaattgaatgctagcatattttcacatatagaatgtaactgtcagaataaaaacaaaaaatact

SEQ ID NO: 83208 - DNA, 448 bp, Homo sapiens
attttttaagttgtaaagatatcttggccaggcatggtagctcatgcctgtaatcccagcactttgagaggcagaggcaggaggagtgcttgagcctaggagttcaagaccagcctgggcaacatggtgagaccctgtctctacaaaaaataacataaaaattagctgggtgtggtgtgctcacagctatttgggaggctaaggcaggaggatcactcgagcccaagagattgaggctgcagtgagctatgtttgcaccactgcactccagccagggtgacagagcaagactttgtctccaaaaaaaaaaaaaaaagcctgagaccaaaatttgagaactgctgttttagtccatcttttataatgatctaactatagaacaaaagtaaaaatcaaaaggcataatagtactctcattcattatcaaaagatatagcttgagaccaaa

SEQ ID NO: 83209 - DNA, 315 bp, Homo sapiens
cacaaatcaaaatgcataactcaatgaattttcgccaagtactcatttagctggctcccaggaaagtaacagaacacacaccagccccttagaagccccgtgtcacttttaatcacagtctttaacccttgctcccctagagtaactacctacttttctgacttacaatcatatagttttgttttgttttgtttttttgcttgcttttaagttttacatgaatggtatcctacactatgattgttctagcttctttttttttttttttttttgagacggagtgtcgctttgtcgcccaggctggagttcagtgtt

SEQ ID NO: 83210 - DNA, 751 bp, Homo sapiens
tttataagttttccaaaatcccaaagtagaagtttccttaaaaaaatcatcttgtataataccagtattcaaacatgggtaaggttaatcacccccaatcactcaggagatagttgcagaatttgaattacaatctcttcttactttcctagcctgtggcttgtcacttctccaaattgccatgctaaatatgcatgaaaattgagggagaatgctagttaaaaagaaattaggatttatcactggaattgaaactaagagtacaaaagtctgaacgaatgaaacttttctccaaattttacaaattcttgttcctttctcattagaagagcatgctatccaaagcataaatctcccttgaaaataacagaggcttcttaagccctctcttagctatgatcaatggatgatattatgcttcccatagctaatgtgatagctccttgcctaggattcctgttgaaataaggattctagccccatgttaagtttttcaaattactacaaattttagataagcatttggagctttttatactagaattatcaattttttattttagctaattacctgtgggcattatacttgaggcaggtaccaaactacttacagcctttttaatgaaaatgtgctgtgtactttgaatccattcatagacaaaattaccttgatgttctcttaactcattctttattttagtgattaaatacaacctttgagttgttcaatatcatttgaaaatggtaggat

SEQ ID NO: 83211 - DNA, 190 bp, Homo sapiens
tggggccctcaagccacctaagttcagagtaaaccggggaactcgtgtggctgcccctcctgtacagattccgactctgcagggtaaacggcctgggctcttcaataaataaagtgtgaggaaaagaatggaccctgccaagcacagtggcacacgcctgtagtcccaggagcttgggaggccgaggcag

SEQ ID NO: 83212 - DNA, 459 bp, Homo sapiens
atgttctgaagaaacacgaatttcatacacaagcgtggatttttgcatgttttaaattgtaaatgcgactaactccaaggaagttggaacttgaagcaggctcaaagcaaacttagtcgcgtcatccgccaccatcctccagggtaaaccgaggagcacagttaattggttttccacgggtatttgccacttgtcagatgggctgttatggacgtaaccacgtaattcctggaacccagtgagagtcagcttcctttacgggcgtctgacaagatgtgctcaaacaccttgaagatctttatggaaacaacttttggctctttatcaagatgtcattcagggctctgaacagtcgaatacgttgtggatgggtttgctgtagttatacagtgtgcatttgatacttgtcaatagcgctagtaatgttattgcaaaaataaaaccttctttaaaaaagag

SEQ ID NO: 83213 - DNA, 809 bp, Homo sapiens
gcttcttgctgaaggtgtggagtggatttcatctcaggctgtgggctccagggagagtggctgatccccgggctgggaaggcaggggcggcctgaggtgagctggggatgccttgcacactcggcccgttgaaatgaacctcacgcggactctagcacacctggctggaacaagggtctgccggtccacacaggtgccattggtgagaggggaggcgagaggccctttctctttgggaagaacgaatgtgagcctaggcaacatattgaaaaattaaaaaactttctaggcattgtgcacacctgtagtctcagctacttgggacgctgaggcaagaggatctcttttaagttcaggagtttgaggatgcagtgagctatgattctaccactgcactccagcctgggtggcagagcaagaccctgtctcaaaaaaataaagaaacccaggtggggccggctgagtctcctctgtctctcgcctcagactacgccctgggcaaggactgcatcatgcatggctacatgtccaagatgggcaaccccttcctgacccagtggcagcggcggtacttctacctgttaccccaaccgactcgagtggcggggcgagggcgaggccccggtaaggagcccatgcggggggtccgggagccgggcttccgggtggctggcccggccggcatcttacctgcaccaccatccctggcctgcagcagagcctgctgaccatggaggagatccagacggaggaggagacgcagatcaggaggcgcaagtgcctgctcctccagatccgcggagggaaga

SEQ ID NO: 83214 - DNA, 998 bp, Homo sapiens
ggcctatgcatcctgctctagctgggagtggaagggccagacctggtgtttccctgggttcttggcctttgtcttctcgacattcagtaggagtgaccgtgctgggccccagacctctgtgaggattcctttttagacccaatgagacatttgtggacagaagatgctctggtgagacagaccttagggtgactctaaaggggatctgagcctaaggattctggaagtttccagtctttggctccacagttcctcaggagaggttcagtctgcctaggactgggcctcccttttcacgaagagtgggcaagagctcaggttgtgaactctgatctggatttattccttcctatgggatgtccagaaggtgttcctgttcctggcttagaagcagaccatgccaaggcatcagattcctcccagcaaggtgatgcttgcagggatgggcaggagggctagggaccaggcctgttgtcctttcagtgaggaaagtgtgtcctgccctgtctgagaggcaggcagcaccaggaggcaaaaatgggctcctgtcctaaaccctgaagagcagtcatgggggaccctcactcacagctgtgccttcttgctgttcctagatttattccagttaagcatttataggcatttatctgtgtgtctgatgccctgacgtttttgctgtaggtaagaagtgatggagtgagctgagctgccaggcttcctggagtgattcttggatgctgggtcacgtggttaggggccctgatgggactgaactggaaggaaccagaataggacagaaccaagcccctgattagtgggcactggtggcctggcctcatgaccacaggacacactgttcccagggcacagacaccctgggctttggttgggtcttggcctccaggtagggccctgttgggcagcgggcagcaactcctgagacactactgtgattcttggtggtggctgtggtaaaaaacctgcagggctagagtttg

SEQ ID NO: 83215 - DNA, 345 bp, Homo sapiens
aaagtattgtatttaggctttggtggctatctggtctctattgtgactactcaattctgcctttcaatacattaatgaataagtatgaccctatttcagtaaaattttatttgaaaaaaacaggtggcaggccagaattggcctgtgggccatagtttgccaccccttagtctagtttcataaagaagcttgttatttttattgagattgcattgtttataaatcttaggagggaacatcttcataatgttgaattgttctatgcaagaacaaaggctgtccttccatttattcaagtctatttttgggtctcaggagggagaagttttcctatgctttatttgg

SEQ ID NO: 83216 - DNA, 946 bp, Homo sapiens
agtgaatcttgatggcagctgcactgagcctggtgacagagcaagatgctgtctcaaaataaatttaaaaataaaataagagaattaaagtttagcaggttgggtggcaaaatgaggccacacatttaaagcccctcctcctgattcttttctctgccttggctgcctcctgtggcattttaggtgctgagaaatgaaaacagtagggaaaatagttccaggatcctcatgttaatttgccagaaatggcatcttcaagtcgtcagagggatctgagagttccttcctggcctgacttgagaaaatccgtctgtccccagctctgcgtctgcctccactgcccagtcacctcctctccatgctcttggggctgggccctaccccaccatgcagtgctgccctggagcagtgagcttggtgggtcctgtctggcatgagagctgcctttgggagctggatcccagcctctaccactgggtctggtgcctagcaggctatggataaacttctgctgactccggcctctcctaagccactgcaacgtggtcggtgtagtgcacagtgtgtgtgcagcgtggccttactcacagcctccacattagagagaatctgactgaagtcttactgctgcctcgtgtgaacataaatgtttgccagaaccatgagcaggaaatgttaatctgccttgtttcctgtcctttacacggaagaatttttttctgtatggaatgcgtgccttacaaataatgagtggaaatacccatcgctaatgaaaagttatacttgactgttagtcagctaaataatctgagatttctaatacttttaatttggcttttacaatgcaatttatcttagcttttttgatttcttaggtcatatctttagaactatatatttgaatgttaatgtaattttcatattgaaattaaaatgttgaactgcg

SEQ ID NO: 83217 - DNA, 569 bp, Homo sapiens
ctttccaaagaaattgctataaggcagtgtatctaggcagggattatgcttaattgagatgcacacagtttaacatctggtgtcaaacctggcttccttctttgtgaccaccctatagatgtttgcttttgggaccactgagtaaaccaggccctgagaatccaagcatgaatccacttctgccctacttttaaggatttacgttccatgcaggaaagcagataaccataatttctgaataaataagacaacaaaatgaaatggatgctggtcaactctgatgcaaattttaagaaggagactatgcctctgtgtctcccagcttcacagaaaaaaaaaaaagaaaaaagaaagatgctcagagtggggtacctacacttggaaaaaacgcaagtataagtctgccattcccatgaatccaagatgaatcctggcacagagtaggtcctcaaattttgcaaaattaattttgaatctttatcaccctggccaatgcactgccataatgcaaatcttactatctacctttctatgtcagtcacatttttaaaactgtgtaacctatgaaa

SEQ ID NO: 83218 - DNA, 1661 bp, Homo sapiens
agcggagtggagtgtgggttggggccgggggtggggggcagaggggggtggcccaggtggccctaggaccccccctccatggaaaaccagctatggcataacaccgtgagatgttgcaatcaataccaagaaagcccccacgatgccgaggacatcttactcctgctgctgggcctcatcgttcttgtcaacattggcatcaacgtggcaactatgatgtggcatggactccagaacgccttagacaagatgattgattgggctactcagaaaaatgaaattcaggccagtgaaagtcccccaagtggtcccccagacaaggctcaggatgtccacatccactgcatcctggaccctgtgcaggtgaagatgtcccgacccacgcagtactcctctttctcctgccaccatttctccaaccatcacagtagcagtcttcttcgctgtgttcgtcgccgccgccgccgccaccgccgttgtcgccgtcgctgctgcaaccaccagcagcggccgcagaactacagacaaatcccccatagccactcagtcttccgtaacccacatcgcagccaaaagatgtcacaactacaccgagtgcctttctttgatcaggaggacccggattcctacctggaggaggaggacaacctgcccttcccgtatcccaagtacccacgtcgcggctggggcgggttttatcagagagcgggcctgccctccaatgtggggctgtggggccaccagggtggtatcctggccagtctgccaccaccctctctctacctgtcacctgagctgcgctgcatgcccaagcgtgtagaggccaggtctgagctgaggctgcagtcctatgggcgccacggttcccaatcccgactgtggggcaatgtggaggctgagcagtgggcctcgtctccaccacctccccaccggctgccccctaacccctcttgggtccccgtggggcacagcccttacccctcagtgggctggatgctgtatgactcctgggatcagcggcgtcgtggcacggagggctttgagcgcccccctgcctcggtgtcccggaacgcccggcctgaggcccagggctgccgggagcaccactccccacagtcccaccagcagagcctgcttggtcacgcctatggccagtcccaccgcagtccccacccatccacggaacccttgggctacagctcccaggacccccgtgaggtgcggcgtcgggcagctgactgggctgaggctctgcccgcctggcgtcctctgactacctctgcctccctcacggtgttggacgaggcctcccatcaacggaccccagctccaagctcagtgctggtcccccattcctcccagccctggcccaaagtccaggctgcggaccctgcccctcccccgaccatgtttgtcccactcagccggaatccagggggcaatgccaactaccaggtgtacgacagcctggagctgaagcggcaggtgcagaagagcagagccaggtccagctcactgccaccggcttccacctccaccttgaggccctctctgcacaggagccagaccgagaaactcaactgaccagcaggcggatgtggggtgtggggcagggcatggagggagaggaataaagagaaacagagtccaggaaacactgt

SEQ ID NO: 83219 - DNA, 1323 bp, Homo sapiens
agcggagtggagtgtgggttggggccgggggtggggggcagaggggggtggcccaggtggccctaggaccccccctccatggaaaaccagctatggcataacaccgtgagatgttgcaatcaataccaagaaagcccccacgatgccgaggacatcttactcctgctgctgggcctcatcgttcttgtcaacattggcatcaacgtggcaactatgatgtggcatggactccagaacgccttagacaagatgattgattgggctactcagaaaagaggacccggattcctacctggaggaggaggacaacctgcccttcccgtatcccaagtacccacgtcgcggctggggcgggttttatcagagagcgggcctgccctccaatgtggggctgtggggccaccagggtggtatcctggccagtctgccaccaccctctctctacctgtcacctgagctgcgctgcatgcccaagcgtgtagaggccaggtctgagctgaggctgcagtcctatgggcgccacggttcccaatcccgactgtggggcaatgtggaggctgagcagtgggcctcgtctccaccacctccccaccggctgccccctaacccctcttgggtccccgtggggcacagcccttacccctcagtgggctggatgctgtatgactcctgggatcagcggcgtcgtggcacggagggctttgagcgcccccctgcctcggtgtcccggaacgcccggcctgaggcccagggctgccgggagcaccactccccacagtcccaccagcagagcctgcttggtcacgcctatggccagtcccaccgcagtccccacccatccacggaacccttgggctacagctcccaggacccccgtgaggtgcggcgtcgggcagctgactgggctgaggctctgcccgcctggcgtcctctgactacctctgcctccctcacggtgttggacgaggcctcccatcaacggaccccagctccaagctcagtgctggtcccccattcctcccagccctggcccaaagtccaggctgcggaccctgcccctcccccgaccatgtttgtcccactcagccggaatccagggggcaatgccaactaccaggtgtacgacagcctggagctgaagcggcaggtgcagaagagcagagccaggtccagctcactgccaccggcttccacctccaccttgaggccctctctgcacaggagccagaccgagaaactcaactgaccagcaggcggatgtggggtgtggggcagggcatggagggagaggaataaagagaaacagagtccaggaaacactgt

SEQ ID NO: 83220 - DNA, 1539 bp, Homo sapiens
attcggcacgagggtaacccacatcgcagccaaaagatgtcacaactacaccgagtgcctttctttgatcaggaggacccggattcctacctggaggaggaggacaacctgcccttcccgtatcccaagtacccacgtcgcggctggggcgggttttatcagagagcgggcctgtcccccaagtggtcccccagacaaggctcaggatgtccacatccactgcatcctggaccctgtgcaggtgaagatgtcccgacccacgcagtactcctctttctcctgccaccatttctccaaccatcacagtagcagtcttcttcgctgtgttcgtcgccgccgccgccgccaccgccgttgtcgccgtcgctgctgcaaccaccagcagcggccgcagaactacagacaaatcccccatagccactcagtcttccgtaacccacatcgcagccaaaagatgtcacaactacaccgagtgcctttctttgatcaggaggacccggattcctacctggaggaggaggacaacctgcccttcccgtatcccaagtacccacgtcgcggctggggcgggttttatcagagagcgggcctgccctccaatgtggggctgtggggccaccagggtggtatcctggccagtctgccaccaccctctctctacctgtcacctgagctgcgctgcatgcccaagcgtgtagaggccaggtctgagctgaggctgcagtcctatgggcgccacggttcccaatcccgactgtggggcaatgtggaggctgagcagtgggcctcgtctccaccacctccccaccggctgccccctaacccctcttgggtccccgtggggcacagcccttacccctcagtgggctggatgctgtatgactcctgggatcagcggcgtcgtggcacggagggctttgagcgcccccctgcctcggtgtcccggaacgcccggcctgaggcccagggctgccgggagcaccactccccacagtcccaccagcagagcctgcttggtcacgcctatggccagtcccaccgcagtccccacccatccacggaacccttgggctacagctcccaggacccccgtgaggtgcggcgtcgggcagctgactgggctgaggctctgcccgcctggcgtcctctgactacctctgcctccctcacggtgttggacgaggcctcccatcaacggaccccagctccaagctcagtgctggtcccccattcctcccagccctggcccaaagtccaggctgcggaccctgcccctcccccgaccatgtttgtcccactcagccggaatccagggggcaatgccaactaccaggtgtacgacagcctggagctgaagcggcaggtgcagaagagcagagccaggtccagctcactgccaccggcttccacctccaccttgaggccctctctgcacaggagccagaccgagaaactcaactgaccagcaggcggatgtggggtgtggggcagggcatggagggagaggaataaagagaaacagagtccaggaaacactgt

SEQ ID NO: 83221 - DNA, 1600 bp, Homo sapiens
agcggagtggagtgtgggttggggccgggggtggggggcagaggggggtggcccaggtggccctaggaccccccctccatggaaaaccagctatggcataacaccgtgagatgttgcaatcaataccaagaaagcccccacgatgccgaggacatcttactcctgctgctgggcctcatcgttcttgtcaacattggcatcaacgtggcaactatgatgtggcatggactccagaacgccttagacaagatgattgattgggctactcagaaaaatgaaattcaggccagtgaaagtcccccaagtggtcccccagacaaggctcaggatgtccacatccactgcatcctggaccctgtgcaggtgaagatgtcccgacccacgcagtactcctctttcgccgccgccaccgccgttgtcgccgtcgctgctgcaaccaccagcagcggccgcagaactacagacaaatcccccatagccactcagtcttccgtaacccacatcgcagccaaaagatgtcacaactacaccgagtgcctttctttgatcaggaggacccggattcctacctggaggaggaggacaacctgcccttcccgtatcccaagtacccacgtcgcggctggggcgggttttatcagagagcgggcctgccctccaatgtggggctgtggggccaccagggtggtatcctggccagtctgccaccaccctctctctacctgtcacctgagctgcgctgcatgcccaagcgtgtagaggccaggtctgagctgaggctgcagtcctatgggcgccacggttcccaatcccgactgtggggcaatgtggaggctgagcagtgggcctcgtctccaccacctccccaccggctgccccctaacccctcttgggtccccgtggggcacagcccttacccctcagtgggctggatgctgtatgactcctgggatcagcggcgtcgtggcacggagggctttgagcgcccccctgcctcggtgtcccggaacgcccggcctgaggcccagggctgccgggagcaccactccccacagtcccaccagcagagcctgcttggtcacgcctatggccagtcccaccgcagtccccacccatccacggaacccttgggctacagctcccaggacccccgtgaggtgcggcgtcgggcagctgactgggctgaggctctgcccgcctggcgtcctctgactacctctgcctccctcacggtgttggacgaggcctcccatcaacggaccccagctccaagctcagtgctggtcccccattcctcccagccctggcccaaagtccaggctgcggaccctgcccctcccccgaccatgtttgtcccactcagccggaatccagggggcaatgccaactaccaggtgtacgacagcctggagctgaagcggcaggtgcagaagagcagagccaggtccagctcactgccaccggcttccacctccaccttgaggccctctctgcacaggagccagaccgagaaactcaactgaccagcaggcggatgtggggtgtggggcagggcatggagggagaggaataaagagaaacagagtccaggaaacactgt

SEQ ID NO: 83222 - DNA, 234 bp, Homo sapiens
gtaatgaattataagaatctgaattgagagctaaaatatctgggttgtaggcctactctgccacgattttcttatttgcaaatattagagctgaactagatgacctcaaaggctctaaccaactccaaaacctacaattcaatggctgactgatatacattgtatactctttaaaaacaattaaaatcaaagaagataataaatgtgtcatgtattatacaactattatacacg

SEQ ID NO: 83223 - DNA, 583 bp, Homo sapiens
gcttcccttgctcagaatccatgctcaccagctgctcataatttggcttcccaggaagatttgcctaaagggagagaataattgatagttacatttctcactgtaaattaaaatattgatagtgttttaaaaaaatagttactgtgagcttggttaatgtgggtttgccatgatagttccactctctatgtactgaaacagtgggcctgaatttttaaggatctgagttatcagactttctgtacacattaaatataggccaaggtatggccatctcacgagagtgaccagctgaccatattcctctactaccctcagacctctatacccacactgtccaatatggtagccactagccacatgtggatattgggtgcctgagatatgactagtccaaactgagatgtgctgtaagtacacaatatacactggatttcaaagacttagtaccccccaaaagaatgtaaaaacatctaattgtttttatattgacattttaaagtgatacaatattttggacgtattggaatagatgttactaaaattaattccatgttttctaaatgtggctactagaaaaccg

SEQ ID NO: 83224 - DNA, 948 bp, Homo sapiens
agcgggagtgggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcggtgcccagtgctgtgtcttcactgacagatgaccttctcaagtactatcaccaggtgactcgtgctgtgctaggggatgatccgcaactgatgaaggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccg

SEQ ID NO: 83225 - DNA, 513 bp, Homo sapiens
agcgggagtgggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccg

SEQ ID NO: 83226 - DNA, 1023 bp, Homo sapiens
agcgggagtgggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcggtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccg

SEQ ID NO: 83227 - DNA, 996 bp, Homo sapiens
agcgggagtgggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcggatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccg

SEQ ID NO: 83228 - DNA, 525 bp, Homo sapiens
  misc_feature (373)..(373): n is a, c, g, or t
  misc_feature (379)..(379): n is a, c, g, or t
  misc_feature (395)..(395): n is a, c, g, or t
  misc_feature (489)..(489): n is a, c, g, or t
  misc_feature (508)..(508): n is a, c, g, or t
  misc_feature (510)..(510): n is a, c, g, or t
agcgggagtgggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgagaaccatgtcagagcgagaagagcgggcggtttgtggagatccctcgggagtctgtccggcngtcccntgccgccagggggcgnggggccggaggacccttctctttcggtgaccctggccgacatttaccgggagctctacgccttcttcggtgacagcttggccacacgctttgcnaccggccagcctgcgaccncnacggtccgcggtcgc

SEQ ID NO: 83229 - DNA, 286 bp, Homo sapiens
ggaaccatcacagattggaggggattaaggagaatgacagctaaatgaaacgtgagagcctggattggatcctggaatagtggaaggatattaagagaaaaactggtgaactctgaatcaagtctgtattttagtaacagtattgcccaatgttgttaatgtaatgattttgataaattatacaagatgctaacattagggaaagctaggtgaaggtgtacagaaaccctctgtgctatatttgtaactttttaatttcaaataaaaagtaaaaaataaaactgtt

SEQ ID NO: 83230 - DNA, 649 bp, Homo sapiens
catttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaa

SEQ ID NO: 83231 - DNA, 504 bp, Homo sapiens
catttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctctagaatacatctttggttgcgtataaggtggtctgttttgttcatcgactaaagaaacattagataagt

SEQ ID NO: 83232 - DNA, 476 bp, Homo sapiens
tctttaaaatagtcttggcagcctaaaataggcattttctggaactagcttggggtaaatgaaacctcgccatcttataaaatgctgtcagatttgcagcatttaatacagatgtcccatattgactggtatttcactgtctatgttgtatttccgcatgttgtatctctcacttaattctcacacagccctgtgagtttgatcttatcccctccacatgaggaaacaggctcagaaagttgagggcttgttgaagtttatgcgtggatgcagagctggagctctggtctttgatctacgtgttgtgctaatgccatggtctgtggacaggttgttactgacagcctgaagcctctcagtgtaggtgcatacagataagttaggcagtgttggtccagagatagtttctatgaataataattaataaaaatgaactattaagtcagaaaattgaacaaatatttattattgagtac

SEQ ID NO: 83233 - DNA, 512 bp, Homo sapiens
ttcatacatcctctgaaatctaggcagaggtccccaaacctcaattcttgacatctgtgcactcgcaggcccaacatcacatgggaactaccaaggcctgggacttgcaccctctcaagcaatggcctgagctgtatgttggcctcttttagccaagtcttaaggctgcacacagcaggagggaaaaaatcatttttcccgtctaggcctctgggtctgtgacaggaggggctgcagtaaaggtctctgacatgtcctggagatattttccccattgtcttgatgattaatcttcagctcattgttacctacgcagatttattcagactgcttgaatttctccccggaaaatggggttttcttttctatcacattgtcaggctgcaaatttttctaacttttatgctttgcttcctcttgaatgctttgctgcttagaaatttcttctgccagataccctagatcaggtctctcaagttcaaagttccacaaatctctggggcaaaggaaaa

SEQ ID NO: 83234 - DNA, 353 bp, Homo sapiens
ctggataatcagggccatgtgctttaacaggatgtaaaggggaagctcatgattaaacatgggaaatatgcagcaaattgcaagacctgagcttaaccgcataattagaacataatttttcacttcttccagagcatcagccaagcaaaggactgagaaatctgcaacccaattgtcctaaaaagaaacttaggcttcacatttgtgacataatttcttttaaaatgaatataaaattttattttttatatttgtagagcataggatgattgaaatccagttgttgttttgtctgacctccatatctaatatggctagtgccgttactactctacagaacgcgcaataagtca

SEQ ID NO: 83235 - DNA, 410 bp, Homo sapiens
ggggcagtgggtgggggatgggaatccgggcctgggactgggacgggatgggtgaggcctcctggatctgttgcctatggcgtggacaggcagaaagcatacccagatggcggtaccttgcaaaccagttcatcaaggtgcattgagggcacatgtcctgcgcgctgaatcctgtggggagcccagtgacctataattcccaggccgcattcaattccgcccatccaaaactgtgctggaaggagtgaagggtaccacggtgaatgtggcaaagtccttccccaagttgaaaatctaccaacagtaatgacttatgtagtgggctcatcctaggtacctggcactttgctaagtgctttatgcagttatttaatcctcgcagcaatcctaggaggtgagcactattattg

SEQ ID NO: 83236 - DNA, 1229 bp, Homo sapiens
gctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgaatactgtctaaatatgttttgatatatgtgttttgccctgtgccattcatttggaacattgttgctttcttcctttattttaaaaagcttgtttttaggtaatcatagagctggctatttatacatcttttgagcaacactgcataaactgatattcagatgatttagctacagcagtacaatgattagcaatgtaaaaattaacacagaaattaacctaaggaatgaagggtgggtttgtcaaaatatcaagtaaatttttgtttcta

SEQ ID NO: 83237 - DNA, 370 bp, Homo sapiens
gacttgtaccctaactgacgtgctcagacagccgcgtcgactggccggagcatcaacggctacacgttgcccctcacactgctcccgtggcgagcgcggggcggatggagaagctctctgtggaagctctcaaaagactgacgggcgagttcaaagggaagtactaccctctgaagagcatgacggagaaggagcagcagcagctcatcgatgaccacttcctgttcgacaagcccgtgtccccgctggtgctggcctcaggcatggcccgagactgaccctctctgttctccatgatcttctcaaatctctctgatttagtccttcatttaataaacattttcttttcttttttttttttttttttttt

SEQ ID NO: 83238 - DNA, 430 bp, Homo sapiens
gtagagacggggtttccaccatgttggccaggctggttttgaactcctgacctccaataatcgacccacttcagcctcccaaattgctgggattataggcatgagccaccgtgcctggccaggaattttaattcttaagccaaacacttgaaagtttctttttatggtctggtggtttttacttattgagagaaagatgaaataaagaaataaaacatttatagatgtgaactttatgtgtgatttatgatctagattattatagtagtatttcttttttcataaaatatttattttatttatgaaattgaaataatgtctatcttcttcatagcaccgtggagcagagaagagaggttggagtggtggggaatattactttaggaacactgattgtaagaggcattaatttggcactttacgggggtac

SEQ ID NO: 83239 - DNA, 430 bp, Homo sapiens
gtagagacggggtttccaccatgttggccaggctggttttgaactcctgacctccaataatcgacccacttcagcctcccaaattgctgggattataggcatgagccaccgtgcctggccaggaattttaattcttaagccaaacacttgaaagtttctttttatggtctggtggtttttacttattgagagaaagatgaaataaagaaataaaacatttatagatgtgaactttatgtgtgatttatgatctagattattatagtagtatttcttttttcataaaatatttattttatttatgaaattgaaataatgtctatcttcttcatagcaccgtggagcagagaagagaggttggagtggtggggaatattactttaggaacactgattgtaagaggcattaaatatgggcaaaagtttaaaaa

SEQ ID NO: 83240 - DNA, 636 bp, Homo sapiens
catactctggcctcgttcgtctctgttgaaaggaaatggcagcctcttgccataccaggaaagggtaagtcacaaaaagtgattttgctcttgtttattctgtgacgtacatttctttgaaaaacattttagtttttcaaccccagaagggaaaccatcagccatgctaaaatttattgttaagcctagcaaagtggaaatgatcgtggaaaatattagagaggtataatttttattttttgagactttgtacaaatagtaaaacatgcctttccccatatcagttcagacttacccacaaaagcccaggcagccaaatggactataacaacccaggtgtcatttattttcttaagatatcatttaatgtaacaagacagaaagagccagaggttcactaccaggaagaaaatgatatggccatgaatagtgtgatttgcatttaacttttaattttagaacggctaaatgaaaagaaaaaatgctaaatatattttaatctaccaagtgaatgaatgctttctagcttgttttctaaactgctcagaagagtgggaattgctgtaagaaccctcctctgtactggattaaattattctggagggccatccaaggtaaagtctctcctttatttaa

SEQ ID NO: 83241 - DNA, 313 bp, Homo sapiens
acaagccttttgagtcataatcagcatatgtatgtaagaaaccccccctaggctggaggaggaacaggaagaaatgaacacgcagaaaaatccttggattacacacaagcatttccaccagctggagtggaaacgcctcctaacatttggagaatcacagtggaccttaagtaaggagtattgcctctctgggtggctcagatttgctctacagtaaaggctgtctcgaactctcctcacaaagcatacatgcaagccatgaaaaggccatactttccaagtaagttagcaattttccaaacagaggctaata

SEQ ID NO: 83242 - DNA, 257 bp, Homo sapiens
cataactgcagctgttccttaagtaatttgtatctgctttaaaccactagagaattaaactattctcaatcaattctaaagggtgctggaaatacatgtctttcagcatcttcaggctgagtttcaagtgctagtttcctgctagtttcccagtgcatgcctcacattttggcccagtcaagtaagtcccatcaccagcaaatccacagtgattccacatcaggaaattcccagtggttccatatctgagcttgctc

SEQ ID NO: 83243 - DNA, 1178 bp, Homo sapiens
  misc_feature (7)..(7): n is a, c, g, or t
  misc_feature (363)..(363): n is a, c, g, or t
  misc_feature (475)..(475): n is a, c, g, or t
ggacggngcagctctctggtgtgctgctttcccagccaccccaggtcatgacccaacactgtactgatggctcttgggcagaatgtctagggactctgtggccctcatactggctggttactaggctgggcacagcacttcctgaaatgtttgaagagtaggcatgatccagttaaagtctcttatgcccctgccattctctctctcttttttttttttttttttttttttgggggaaagggggctcaaaagttcccccggggggcgccacaagttataagcgggttccccgggtttcctgggcaactgtggggcgccccatatatgagggagcgcctggattaataacgagctacacggcangcggcgccgcgcagtgtttacaacaaccggtcgaggagcctggggaaaaacgggcgcaccgcggggcgactctgtgggagaaggggaccacctttatcctctccgtgtgggngcggggcgcaccaatatagtgtggcgcgacaaaaaacccacaccctatcacagagagaagatttataaaacgcgcctcatagaggaggggaatactttttatcaacatttttctagacggggtgttaatatacggtgtgtggtacacaccaatcacgacgcgcggaaatattatttgctgtgcgcggacggtgttaacgagaagagctgtgtgggggccatacaccgcagggggcagtatatatagaattatttgcgtggagaacacaacattatttttttattctccacgcgggagagagggcatatagtttttggtgtgaaaaaaaaataaaaggggggggtggctgaagattaccggagaaagaggagacatacataaacgtgcgacggcaagaacaactacccctagagggagacgcacgttggcaactacagacccgcaattctatggaggcagagggtgtggtcacaacaaggcagaggggcggcataagctccaacaaaaaaacgaccaccagcaaagaggagatgacgtaatgagtgcggacacgcgaaagccgaagcggagagacactacttaggcgaagagtgcacccgaaacaagcaacacagacaacaacctaggcacccctggtgacgacacaactacttagagaacacccacaggcacaagaacagagaacgaagaaggaaaaaaaggc

SEQ ID NO: 83244 - DNA, 484 bp, Homo sapiens
tttcaaagacagctatgagggggaattctctcagtgtgcagggcttcacgcactacacttggtcatcaaattcatgttgaaagagatgcagcctcagcctcagtttgcgcaaacttaatttacccaaaccaagggaaccccgggcgcctaaggttgggccctttgggaaacaaggggggggccaacaaggaacaaggaaattccaattcaaggaaggggcccttaggtgggggaaggacggaaaaagtttacgggaggcaatccatacgcacaagggataatctcgggacagtaagtggtttagtcgttagacttgaacacttaatgtggacgaagacacaatgtgggaagatctttcagttgcaggttaacacctaccagaaatcatctattttggaagaggcactagacagccaagtagatggactgactcagccacttgatgccagccagtttctgtcattggccattccagtgctgctga

SEQ ID NO: 83245 - DNA, 1358 bp, Homo sapiens
ccattatcagattagatgcaaagtgggctggcatgccagggggtgacaggaacagtgtctccagaaatcctctgtgaagacacccaagtattgttcagaagtggccctgtatctggaagagggaaaactgcacccacttcttgcagacatacagttccagctccccccacaggacttgctcatacatccaacaaatatttaatcagtgcccaccatctgccactgtgccaggtgcccggcctcatcatgagtcaggcagaggtggtctgtgcagttttcccacaatgtgagagggtgctgagaagacttttaacgcttatttaactacggaaataactcttggtttggtacctactacaaaataaaaacaagcgcttgttgataatttctggatggatgactgtggaaagctggaggagactgaggatcaatttgctctaatgaaccttcccttgactatcatctccgttacctcctgccgcatccctacggcaaatatgcaagactctcacgcagctaatttccaggggtttgcagtctggggaggaagcagaaagcacatccctcactgaccctgaggaggggcaaatctctggtagcagtcacaggtacgtgctgtacacacttcccatcctttgagccttcccagctggagagcaccaagagaacgcagttggggaggccccgaaagatgaagggttgttgagcttgaaggcagtgaaaaagtaaatggaagaaagctctctgccctccactgcctaaatgcaggatatagatttagaaggataaaaggggtctgctccctctctcgaccagggaaaagttaaccactgaagacaactttagactcttatgggcctggagctggaaccagaggaatggacatgaaggcgctttactaactctatttatctgccagttacttacctttctacaagttctccccttagacactcaaagttcttttcctttgtcctgtcgcttccctaaaacttggcttttctttgttgaagatgctatacaagctggaattcaaagctaccactttgagaactactcaattcctgcgtgtctcccaggcagatgtgaaatacacatgttaataaacttccactggtttttctcttgttaatctgtcttttgtaacaggagtccgttccaaccacaaatctaggggggctgaggaaaaacccctacagtggcacacactgaagaaggccccctcactttccaaggtttcccatctcaggtggaaggaggcctgctaagtcatgtgaaaattattcaggaaaagatcaaagtgcttctacttctgcagttctaaaaatatctttaagtgcatgaaaacatgtataatg

SEQ ID NO: 83246 - DNA, 352 bp, Homo sapiens
gataatgtaaatttttgcttctgggcttgtcatcaggattgcaatttttagatttagtttgctaattgtttggcctttgaaaaattatatacacttggtttgttttggttttcttaagtcaaaacaaggaaataaaatcacatttgctttccaagaaaagataatgtttaagtggttgtttagtgttttgtgtctttgggggtgggagggggtgtgtggaatacacaaacacacacacacaaacacacacagtctatatataatcttattggagccatcactatattttaagaaaatgaaataatctattgaagcttaaaattagaattttgattaagctaagagctatttt

SEQ ID NO: 83247 - DNA, 613 bp, Homo sapiens
cttcagaaggattatgggaggaagttgtgtaaattagaacatagttatattacaaataatccaatcacagaacccagagtatgtacctttgtgcatattttcaatctcatttcctttttctttttttttagaccaagtcttgcacttgtcccccaggctggagtgcaatggtgtgatctcggctcactgcaacctctgcctcccaggttcaagtgattgtcctgcctcaccctcctgagtagctgggattacaggtgcctgccaccaagcctggctaatttttgtatttttagtagagatggggtttcaccatgttggccaggctggtctcgaactcctgacctcaggtgatctgcccgccttggcctcccaaagtgctggaattacaggcatgagccactgcgccggcctcttttttcctttgagacagagtctcactctgtcgcccaggctggagtgcagtggcacaatctcggctcactgcaacctccacctcctgggttctagcgattctcgtgcctcagcctcctgagtggctggaattacagatgtgtgctaccacgtccagctagttttttgtatttttagtagagacgaggtttcaccatgttgg

SEQ ID NO: 83248 - DNA, 432 bp, Homo sapiens
cagaattagagctgtaccccaagggggaattctgtcctaggagacagtgagtgctaagtacactctggacaagcaccagacacagaagctgcctcagtttgtgctccccctgcaaagcagagcctgagacaaggatttgggtacaaggagtttcactcaatattatatttccaagatgcacccatgctttatatggctatagtgcatccattttactgctttatactttccattaggtgactatattagtatatatttataattcctaggtctttttgttctcttatttgttaataattataaactccaagcccattgtggtagattgctatttctcagagatattttctgctccttcctgggggacaataatacttttctcccatcaatggcagatgtgggcttgtgacattttctggtcaatgaaatgag

SEQ ID NO: 83249 - DNA, 425 bp, Homo sapiens
agctcattcctgagatgagaggctcagtcacgaaaacattgccaagcacttgtggcctctcccatgcaactaagcacctggtcatccccacttcccaacgtgcagcatgtgtcacccatcttttcatatccatttctatggtatttggattaaaaattaaaccctccaaatttcagcagacaacactaggtgaccaccacctgtctgtagtgatctcgataccatcacggatctatctcttgacagctgactccaacgccaacttgcttttcctctgacctgtttcaccaggtgctcacacctactcacccatgtctcagagactatagactttgtgatatacctgattatacagccccagcctatctgccattgcatcagagcagctgcacttgaccaaggagctctcgctgcacacactgtgc

SEQ ID NO: 83250 - DNA, 795 bp, Homo sapiens
gtctttcactctctcatactttctcctctcccctctcccaagcacatctgagttgctgcctgttcttcacacttagctccaaacccatgaaaaattgccaagtataaaagcttctcaagaatgagatggattctagggtgtcttcacctgagaagcaagataaagagaatttcgtgggtgtcaacaataaacggcttggtgtatgtggctggatcctgttttccctctctttcctgttggtgatcattaccttccccatctccatatggatgtgcttgaagatcattaaggagtatgaacgtgctgttgtattccgtctgggacgcatccaagctgacaaagccaaggggccaggtttgatcctggtcctgccatgcatagatgtgtttgtcaaagttgacctccgaacagttacttgcaacattcctccacaagagatcctcaccagagactccgtaactactcaggtagatggagttgtctattacagaatctatagtgctgtctcagcagtggctaatgtcaacgatgtccatcaagcaacatttctgctggctcaaaccactctgagaaatgtcttagggacacagaccttgtcccagatcttagctggacgagaagagatcgcccatagcatccagactttacttgatgatgccaccgaactgtgggggatccgggtggcccgagtggaaatcaaagatgttcggattcccgtgcagttgcagagatccatggcagccgaggctgaggccacccgggaagcgagagccaaggtaagtgttgtgcagttca

SEQ ID NO: 83251 - DNA, 3612 bp, Homo sapiens
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgccttagttgttgtgaagcctgtgattctcagctgggactgaggatgggctataggagttgagttatagattggaaggaaatgtgtatcataagaaggcaaaaaataccaggagctttgcaaattgtattaatacactccttttctattgctcttgtatgaagctattgtcagctggaatggtttgcatcccccggtacattgaggtagaaaaaacaattgtggttgtgcctgtaatcccagcactttgggatgctgaagcgggaaaactggttgagcccaagagttcaagaccagcctggccaacatgatgaaatcccatctctacaaaaaatacaaaaatttgccaggtgtgatggtgcatgcctgtagtcccagctactcaggtggctgagatgtgaggatcacttaagcctgggaggcgaaggttgcagtgagccaagatcatgccacactacactccagcctggataacagagggaggccttgtccctgctaaaaataaaataataattgtgtgcc

SEQ ID NO: 83252 - DNA, 3076 bp, Homo sapiens
caatcgcgaaaccggtttcgcgattggtaccaatcgcgaaaccaaatcctgttgccaatccttgtatgtcagtttcccatgggtcttgaatgcaaatacaaatatcgtaaactaaatatttgtgttttctttcctagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgccttagttgttgtgaagcctgtgattctcagctgggactgaggatgggctataggagttgagttatagattggaaggaaatgtgtatcataagaaggcaaaaaataccaggagctttgcaaattgtattaatacactccttttctattgctcttgtatgaagctattgtcagctggaatggtttgcatcccccggtacattgaggtagaaaaaacaattgtggttgtgcctgtaatcccagcactttgggatgctgaagcgggaaaactggttgagcccaagagttcaagaccagcctggccaacatgatgaaatcccatctctacaaaaaatacaaaaatttgccaggtgtgatggtgcatgcctgtagtcccagctactcaggtggctgagatgtgaggatcacttaagcctgggaggcgaaggttgcagtgagccaagatcatgccacactacactccagcctggataacagagggaggccttgtccctgctaaaaataaaataataattgtgtgcc

SEQ ID NO: 83253 - DNA, 462 bp, Homo sapiens
cacagtgacattaatttcataactgtgtatcagaatgctgctaaaataaccagcttcctaataggtgggtcttagaaaaagccagcttgactgaagttctcaccgtctcacatttttattttgttgtaggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactggtatgtgttttctacctagataacccacactgtgtgtttggcattctggcttttgtttttttgtccatttgcattaaccaaaggtttttatcgtttgattgggtcttatctgagggtgcactgcctcaaagcatttgtttttctgaatttattggctacttgggg

SEQ ID NO: 83254 - DNA, 486 bp, Homo sapiens
atgactttggggttatttagaatctcgcttgtatttttgtgttctagatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacgtaagtatctttggacatatacctttttggctcaaagagactagttattcaggagacaaacaagctccttcctgtaatctgaagaccctccatggagggtggaaagctccctcagagcaccgtccgtcttccttctccagagacatatcttagaatcatgcggggttactagagctt

SEQ ID NO: 83255 - DNA, 3381 bp, Homo sapiens
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgccttagttgttgtgaagcctgtgattctcagctgggactgaggatgggctataggagttgagttatagattggaaggaaatgtgtatcataagaaggcaaaaaataccaggagctttgcaaattgtattaatacactccttttctattgctcttgtatgaagctattgtcagctggaatggtttgcatcccccggtacattgaggtagaaaaaacaattgtggttgtgcctgtaatcccagcactttgggatgctgaagcgggaaaactggttgagcccaagagttcaagaccagcctggccaacatgatgaaatcccatctctacaaaaaatacaaaaatttgccaggtgtgatggtgcatgcctgtagtcccagctactcaggtggctgagatgtgaggatcacttaagcctgggaggcgaaggttgcagtgagccaagatcatgccacactacactccagcctggataacagagggaggccttgtccctgctaaaaataaaataataattgtgtgcc

SEQ ID NO: 83256 - DNA, 3023 bp, Homo sapiens
cgcggggaagcggggacccgctgtcactgcgcctcccgctgccgacgccgcctggacggccgcactctccctgcccgagacccgactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgccttagttgttgtgaagcctgtgattctcagctgggactgaggatgggctataggagttgagttatagattggaaggaaatgtgtatcataagaaggcaaaaaataccaggagctttgcaaattgtattaatacactccttttctattgctcttgtatgaagctattgtcagctggaatggtttgcatcccccggtacattgaggtagaaaaaacaattgtggttgtgcctgtaatcccagcactttgggatgctgaagcgggaaaactggttgagcccaagagttcaagaccagcctggccaacatgatgaaatcccatctctacaaaaaatacaaaaatttgccaggtgtgatggtgcatgcctgtagtcccagctactcaggtggctgagatgtgaggatcacttaagcctgggaggcgaaggttgcagtgagccaagatcatgccacactacactccagcctggataacagagggaggccttgtccctgctaaaaataaaataataattgtgtgcc

SEQ ID NO: 83257 - DNA, 3562 bp, Homo sapiens
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacgtaagtatctttggacatatacatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgccttagttgttgtgaagcctgtgattctcagctgggactgaggatgggctataggagttgagttatagattggaaggaaatgtgtatcataagaaggcaaaaaataccaggagctttgcaaattgtattaatacactccttttctattgctcttgtatgaagctattgtcagctggaatggtttgcatcccccggtacattgaggtagaaaaaacaattgtggttgtgcctgtaatcccagcactttgggatgctgaagcgggaaaactggttgagcccaagagttcaagaccagcctggccaacatgatgaaatcccatctctacaaaaaatacaaaaatttgccaggtgtgatggtgcatgcctgtagtcccagctactcaggtggctgagatgtgaggatcacttaagcctgggaggcgaaggttgcagtgagccaagatcatgccacactacactccagcctggataacagagggaggccttgtccctgctaaaaataaaataataattgtgtgcc

SEQ ID NO: 83258 - DNA, 2188 bp, Homo sapiens
  misc_feature (31)..(31): n is a, c, g, or t
tacgctaccctagaggttaccgactagtccnaacatacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgccttagttgttgtgaagcctgtgattctcagctgggactgaggatgggctataggagttgagttatagattggaaggaaatgtgtatcataagaaggcaaaaaataccaggagctttgcaaattgtattaatacactccttttctattgctcttgtatgaagctattgtcagctggaatggtttgcatcccccggtacattgaggtagaaaaaacaattgtggttgtgcctgtaatcccagcactttgggatgctgaagcgggaaaactggttgagcccaagagttcaagaccagcctggccaacatgatgaaatcccatctctacaaaaaatacaaaaatttgccaggtgtgatggtgcatgcctgtagtcccagctactcaggtggctgagatgtgaggatcacttaagcctgggaggcgaaggttgcagtgagccaagatcatgccacactacactccagcctggataacagagggaggccttgtccctgctaaaaataaaataataattgtgtgcc

SEQ ID NO: 83259 - DNA, 3559 bp, Homo sapiens
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctatctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgccttagttgttgtgaagcctgtgattctcagctgggactgaggatgggctataggagttgagttatagattggaaggaaatgtgtatcataagaaggcaaaaaataccaggagctttgcaaattgtattaatacactccttttctattgctcttgtatgaagctattgtcagctggaatggtttgcatcccccggtacattgaggtagaaaaaacaattgtggttgtgcctgtaatcccagcactttgggatgctgaagcgggaaaactggttgagcccaagagttcaagaccagcctggccaacatgatgaaatcccatctctacaaaaaatacaaaaatttgccaggtgtgatggtgcatgcctgtagtcccagctactcaggtggctgagatgtgaggatcacttaagcctgggaggcgaaggttgcagtgagccaagatcatgccacactacactccagcctggataacagagggaggccttgtccctgctaaaaataaaataataattgtgtgcc

SEQ ID NO: 83260 - DNA, 1231 bp, Homo sapiens
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtacgtttctttccgatcagttgggtgctatgtgctcagctttcctactgcagcttcatttaatgcagagtggtgtttgaatttggcttagatgggctggcaggcatgattttaaaaaatgtaatcatcagtaagaagtacttccatgttaaagatgcaaaaaaaaaagtcttcattaaaatttctatttaaagattat

SEQ ID NO: 83261 - DNA, 397 bp, Homo sapiens
ctgagctgctcttgattcgtgtgtatgtttagtgaaagtttgttttcagtgcctgtagctgataccactgactctgtgagtaagagtaagctctctggatctcaggtttccctctgcaaagtgagctggactaaaggttatcttaggtccctttcaactctgcactgtcaacttgaattcatacacacagttgacacagaaccctcgttttctgaacaaaagcatataaaatcctgttgccaatccttgtatgtcagtttcccatgggtcttgaatgcaaatacaaatatcgtaaactaaatatttgtgttttctttcctagactctccagaaagagcaacagtaatggagtacatgagcactggaagtgacaataaagaagagattgatttattaa

SEQ ID NO: 83262 - DNA, 605 bp, Homo sapiens
gatcacttgagcccaggagttcgaggctacggtgagttgtgttggtgccactgtactccagcctggatgacagagcaaagaccctgtctcaaaaggaaaagaaaaaagaaattaaagggaagcttgcttgcttaagggctgaactgcattcgttgcagggcatgtggtggaaaacggattactttctaggtcctggtactagcatgcttttgctgttgagggtgtatcaccatacctttgatgctaagagagctggtttgttgatagatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctggtagggacaccctgctgtgtgccgcacacttacttcccttctctttctgtccacatcaaacctctgatgtagttcatgaaagcacttggaa

SEQ ID NO: 83263 - DNA, 3052 bp, Homo sapiens
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtcca

SEQ ID NO: 83264 - DNA, 2245 bp, Homo sapiens
  misc_feature (1)..(1): n is a, c, g, or t
ngatattaaacctagcaacattgttttcatgtcatgatggatcactttctttgagtgtagaaaatcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgccttagttgttgtgaagcctgtgattctcagctgggactgaggatgggctataggagttgagttatagattggaaggaaatgtgtatcataagaaggcaaaaaataccaggagctttgcaaattgtattaatacactccttttctattgctcttgtatgaagctattgtcagctggaatggtttgcatcccccggtacattgaggtagaaaaaacaattgtggttgtgcctgtaatcccagcactttgggatgctgaagcgggaaaactggttgagcccaagagttcaagaccagcctggccaacatgatgaaatcccatctctacaaaaaatacaaaaatttgccaggtgtgatggtgcatgcctgtagtcccagctactcaggtggctgagatgtgaggatcacttaagcctgggaggcgaaggttgcagtgagccaagatcatgccacactacactccagcctggataacagagggaggccttgtccctgctaaaaataaaataataattgtgtgcc

SEQ ID NO: 83265 - DNA, 1639 bp, Homo sapiens
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacgtaagtatctttggacatatacctttttggctcaaagagactagttattcaggagacaaacaagctccttcctgtaatctgaagaccctccatggagggtggaaagctccctcagagcaccgtccgtcttccttctccagagacatatcttagaatcatgcggggttactagagctt

SEQ ID NO: 83266 - DNA, 428 bp, Homo sapiens
ctatttttaaagggaaacatcttttctgggttgagaagaagcaagatcacaaaataaaggaggttgaaaaaattaccgaaatacttttgtgcacgagagtctagccttacgaaatggctggacaggtgtagtccttggtctttctctgcgtgaggtataaaatggtttttaagtataaaaccctgccaggcacagtggctcaggcctgtaatccccgcacattgggaggccaaggagggtggatcatgaggtcaggagttcgagaccagcctggccaatatggtgatgccccatctctactaaaatacaaaacttagctgtgcatggtggcgcacacctgtagtcccagctacttagaaggctgaggtgggagagttgcttgagccctggaggatgaggctgtggtgagctatgatcatgccattgcg

SEQ ID NO: 83267 - DNA, 387 bp, Homo sapiens
gttggcaggcacctgtaatcccagctactcaggaggctgaagcaggagaatcgcttgaacctgggaggtggaggatgcagtgagctgagatcacgccactgtgctccagcctgggtgacaagagtgaaactccatctcaaaaaaaaaaaaaaaaattgtaggtcacactgtactatcatttctggcttgcctgaatactgcccaactcagctccaagcccctctatgggcctgcaggtggagtgcccttaagggagggctcaccccaacaagccaccctgtcctgctggagcagccaactggcagaaagacagtcagtcagcagggcctcgttttttcttgcctctgacagaagagcagagcacagctctacaaatggtacttccag

SEQ ID NO: 83268 - DNA, 412 bp, Homo sapiens
ggtttcaccatgttggccaggctggtcttgaactcctgacttcaggtgatccacctgccttggcctcccaaagtgctgggatgacaggcatcagccatcgtgaccggcctacatttttttaaaaaggtaataacaatcatgaatggagttgttttgggttttattttcataattgtcctcagaaagataaggtaaatgtgtgtactggcagttttcccatttctgagcatgctttgttgaggaataataaaagagaatgactctgccataaagactatctgcagaaaaacacagttcttattaattcaagtttccttttgcttaaagagccagaactcagtaatctccacaacttcagaataaaccacccaggactcatcaacatcattttatcctgaaaccatatggattt

SEQ ID NO: 83269 - DNA, 516 bp, Homo sapiens
ccagatttgctaaacagataaggcagcaatatgtcatgaaaatgaatactcaagaggccaagcagaaagcagatattaaaatcaaagacagaacactatttgtggatcagaatttgtcaatgtctgtgcaagataatgaaagcaaccgagaaccttcagatcctagtcagtgtgatgctaacaatatgaagcattctgacttgaataatctcaaactctcagtccctgataatagacagctgttagagcaggagagcatcatgaaggctcagccccaacatgagtctctgggaattatttggaacttgttgcaaaatctattcaagattggattacaaaagaagaagctatatatcaggaatctaaaatgaatgagaaaatcatcaggaccagagctgagctggaattgaaatcttctgctaatgccaaacttacttctgctagcaaaattttttccattaaagaatctaaaagtaacaaaggaatcagcaaaacagagatatcagatcaagaaaa

SEQ ID NO: 83270 - DNA, 443 bp, Homo sapiens
cagcagcgcagtctaatggactggagttttactgaacattttaaaccgaaagtactgcttcaggtccttcaagaagcccataagcaatataggtgtgttgattcttactaccacacccaagacaactctttacttttagtctttcacaatccaatgaatagacaacgtttgcattgtgaatattggaacattgctctccactccaatgttggattcaggaattatttggaacttgttgcaaaatctattcaagattggattacaaaagaagaagctatatatcaggaatctaaaatgaatgagaaaatcatcaggaccagagctgagctggaattgaaatcttctgctaatgccaaacttacttctgctagcaaaattttttccattaaagaatctaaaagtaacaaaggaatcagcaaaacagagatatcagatcaagaaaa

SEQ ID NO: 83271 - DNA, 365 bp, Homo sapiens
ccagatttgctaaacagataaggcagcaatatgtcatgaaaatgaatactcaagaggccaagcagaaagcagatattaaaatcaaagacagaacactatttgtggatcagaatttgtcaatgtctgtgcaagataatgaaagcaaccgagaaccttcagatcctagtcagtgtgatgctaacaatatgaagcattctgacttgaataatctcaaactctcagtccctgataatagacagctgttagagcaggagagcatcatgaaggctcagccccaacatgagtctctgggtaagttaaagtgtgtgtgtgtgtgtgtgtgtgtgtgtgtgtaagacactattatagtacacataaatcaaaaa

SEQ ID NO: 83272 - DNA, 328 bp, Homo sapiens
gctagacattatgaaaaaagaatgggcagttttgaagagtaaatgcagtcattgaaataatgggcatataacaatggtgatagatgatacattaaatattgaaaaaaattcatgagtctgctactgaaggaggaaggaatgaagggaaagaaggaagaaggtggggggagtgcaaggaaaagagaaagaagatggacaagctcttttctacagaataccgtcaatgaatgtagaaggaattataaaattagaaaatcatcattttacacactccaatgtaatcatttatatgggaaagggtcatcagtagatgccaatacaactggat

SEQ ID NO: 83273 - DNA, 838 bp, Homo sapiens
tattctccacagactcctctccattggatctctagcacctagaatagagctgggtacacatgatgaggtgcttaatacgtatttgtcaaattgaatgtcaagttttaggagtttaaagagtgttttcaaatggggagaagccgagacacaaatagtctcaggaatgagatgaaattatttaaccaattggagatgaaattcgaaatggaaactatgacatgactcaacatcctcaagccctgaagtaataattagcacataaagttggtctgttatggactttgtgttgtgctccctgcaaaattggatacagagagaagacagctgtctgcaaaccagaaagagagtcctcactgcacttcatatctgccaatggatccttgctcttgaacctcccaacctgcagaatcatgagaaacaaacattgtgtaagccacccactctacagtaatttgttctagcagaccgagctgactgaggttaaaattcctatgcgaatctgactgacccagcttgggcttcattccaacctcttggctagataagagtgtggaaccttaactgatggtccctttgactgcccgccacaagggaagatccaaagtgtggcagagagtgaccaggtcccagacaggcaaaatcagcagatgtccattcgcaagccaaaagagctccagaaaatgttctctttgaatagaaaccatgtttgctatactcatcctggaaagtggccatcctgctggtccttagagcaggctgtgcctgggagccatctttgaatatcctctgagctcagagggagagacatacctctagtgaggatcctggaaacctccgt

SEQ ID NO: 83274 - DNA, 357 bp, Homo sapiens
cataagtctctactgatataaagcacaattgaataataactgggagagggagggagaataaataagttctacgtaaaagaatttcttataaattttgtagatatgactttctaaacaaattctcattcttaagaattcatagtgacttccttccaaaaattacaatatggaaaactgataaaaaatgagtaactctacagtggaggaatctgacacatactacatcagccaggttattgaggtcaacatcaacagccataaatcatgtgaacagtatgtacacttggtatgatgtaacgaatagcacttcacttctgtggtctttctccccaggctcattatctcagtataatcatg

SEQ ID NO: 83275 - DNA, 824 bp, Homo sapiens
caatgtatatgggaaaatgattttaccaacttaagaacttacaactccagtacttaatatgtgttgactgtgagtgtatgtgtgtctgtgtgtatgttttaaatttaactgagatatttgtatacttttttatattctcagaatatggatggatataatacttattttatatactagtatgtgttaaaatggcctattaatgatttattatggacattcttctctaatttaaaaagatcatggagtaggatggttaatatattacttttaaaacaaactgtcaagaggcttgaggagctatatgtttttatttttcttgatcaatccatgtttgatctattgcataatttagtcacttaattcttagttttaaaatgtagtaaggaaatattttatgactcgactgaaggacatagaatgctgttgacattttactgggaaatttttttattgtgaggggttgtctagcccacctgctgtaggctaatagtgccctccaagttttgggacaaccaagaaatgctcccagacatttccaaaagaacctctgtctcatttctgtcctgttttttttgtttgtttttttttgttttttgtttttttttagcttctccctctctattgtacctatctattcaacccaagtctctcccatctttaaaaaacttcctcccttggccccattttcccttctacctgctgcagaatgttctcttccctttcaaaatgaaattcttaagtaattatttcttgccaatagaaattttattaactaattcatgacactatttttgcatgattcagtgcattttttgggagaaaat

SEQ ID NO: 83276 - DNA, 564 bp, Homo sapiens
ggactgcaggtgtatgccaccatgtccagtgaattctttgttattttttctaatggcagagaaaggaccatattttcttagtctgccaacatttcatgcctctggaattgggcctaaggccaagtgggtagtccgtcacttccctagttcttacagtgtgaatatggggtgacaagaaaatgtgcatttcaaatcaattcccagatgactccaaagtcttacatactagaatagcagacttttctgttcaaagggcagtttttaaagagttgtcatatgtgcccaattttttttcccaagtgtgccatagattttcggtccctccctgttattaaaaaaaaaatcagtttacaaaaaaaaaaaaaaaaaaaaaaaaaaaaaaaaaaaaaaaaaaaaaaaaaaaaaaaaaaaaaaaaaaacaacaaaaaaaaaaaacaaaacaaaaaaaaaaaaaggggggggggccgcacaaaacggcacgcacaccgtgagagacaaaaaaaccaagatcaacaccagacagaaaacagaacgtgcgaaaccgaaggagagacccaaacaaag

SEQ ID NO: 83277 - DNA, 940 bp, Homo sapiens
cccaggacacaaaaactgcggaaggccgcaggacctctgcctaggaaagccagtctctcgttccaccttatgagaaacacccacaggtgtggaggggcaacccacccctacagaaggggccactggggcagggaagagacagatgttggattttagaggatccggtaaaggatgctactcttctccatccaagtttgaaagcgactgagagagacacacaacagtcagacagagagagatcaaaatattttcctgtgacttaagagcaatggccaagctggcttcctgctatcctacccttgaacttgacattcacccactgaaaatgcccagtccctggctcagtggggataccagaggctgctaactgccaggcagcaacagaccaataaaggcttccaaaagagatggtgcgctgggctgggcatgcccaggagctcctcccacgcttggccatcagattaggatcctgagacccggagaagttaagcaacctgtccaagttcacacaacatatgaggagatttattatgaaaattggctcgcgtgatgatagaggccaagaagtcccacgatctgccgtctgcaagctgaggaccaggaaagctagtcatatatgtaattcagactgaatctgaaggcccaagaaccaggagcacgtggatgtcccagctcaagaagagacagagacttctcccttcctctgcctttctgttgtattcaggcacttaatgggactgggtgctgcccaccccttttggcgagaacaaccttcttttatttatttatttattttctgaaatggagtctcgctctgtcacctaggctggagtgcagtggcgcgatattggctcactgcaacctttgcctcccaggttcaagacattctcctgcatcagccccccgagtagctgggattacaggcatgcaccaccatgcc

SEQ ID NO: 83278 - DNA, 601 bp, Homo sapiens
accacatcctctatttttggaagggcatacagcgtgctggtaatgtcactgattaagttttgccttacttcggaaagattctaatgctctcttagcagatgctttgtgctatcgtgaacaatagggcacagatcttttattgatattcaatcacagcatcttatcagtctgagttttttagttcattcaagaaatccatatcttatcattccacaggcttgttctgtgtccttgagctggttcccttgtcttcaagttacagttttcctctctctaaacctgataaccagtgctaccttattaaaaattattatttttttgtccgggcacagtggctcatgcctgtaatcccatcactttgggaggccaagggtggtggatcacctgaggtcaggagtttgagaccagcctgacctatatggcgaaaccccgtatctactaaaaatacaaaaattagccgggcgtggtggcatgtgcctgtaatcccagctactcgggaggcagagacaggagaatcgcttgaacccgggaggtggaggttgcaggagctgagatcgtgccactgcactccagcctgggcgacagagtaagactctatctg

SEQ ID NO: 83279 - DNA, 295 bp, Homo sapiens
attaaatgggcacagaccaggaatgctgccaaacatcaaagtgatacccaatactacccaaaatgacaatagtacggtctagaaatgtcctgagatgccaaacaaccagatgtctacccagacactaagtaaaaatgatgacaataagccaatgcctgtaagtaaaacttttcataaatcataaaaacatctttcagccgggcgcggtggctcacgcttgtaatcccagcactttgggaggtcaaggcaggcgaatcacgaggtcaagagattgagaccaacttggccaacatgg

SEQ ID NO: 83280 - DNA, 471 bp, Homo sapiens
tgtggtattagcgcccactgaaaagccccagtgtaatcaggaattcagggagctctctccgccaagagccccacagggctcccagtctttagcctgcttccttcccaaacctgactgaacaaccaaagatcaccacacgtctgagggaagcctacagcgagaaagagactaacaaagacagaaaaatggacattaacccccaaaagagacaaaatctgactggccataaaagagtgctttaaaatataatttagcaataaatcatctacaaccccccattaacatcccagagaagatcgcattttccaaagatggccatgaggatacttttctacagtgtgaccttggcacccctctgtcaggagcaggagtcgaaatttccttctggagtctgggcaggccctggctacttagcctaattgattgtggcagactaggccagctgtgtgacttctgagcctgggtcataaa

SEQ ID NO: 83281 - DNA, 386 bp, Homo sapiens
atttggctattctagaagcctgtaatctttcgaatttgcccagtcaaccaagcctggggtttaaatgaattttcaacacctttctgctgacagtcacacatgttaaaccttgatttgcttaaaagtattattaaggatgagaatgtaatactgccagtggtatgtggtgatattattgtggcgctggggggatgaaactaacgtctttcagtaaatgtttaattttacacaccatataatcagttgtattattgcaagtgcacagcaggtatgtagaaaaatagaatgcatatatttaacatattagaaataactttattaatattcctatttcatgttctcatgaaattttaatcatttgcattttttagcttcaaacattttta

SEQ ID NO: 83282 - DNA, 274 bp, Homo sapiens
agatcaacacaaagttgctcaaagtgtggaatataaactgatgtttgcccaggaatcatttgttaccagtctgtggtggtaattgaagcctgtttggtcacaaactaggattgcagcatctgcttgtaggctcaaaataaagggatggagaaaaatcgaccaagcaaatggaaaacagaaaagagcaacttgcttcctgaaaattcacgggtctcgctctgttacccaagctggagtgcagcggtgtgatcatggttcactgcagcttcaactt

SEQ ID NO: 83283 - DNA, 865 bp, Homo sapiens
catggacagaagcaggggctaaagctctgttcctctctcctggaagcttgcagacctcccttcagaaccaatcccaagaagccacctatccggaacaacacaagacggagtttttgctcttaccgcccagggtggagtgcaatggcgcaatcttgactcactggcgaatcctcatgggtattgcccgcgttcatgcggcagttcgtccgtgacgcgtcaaggcgcatagcgcgatagctagcgtgagcgtagtcagcgagggcactgacatggcggaacctgaggagattgcctaccttgattccctcggtagtcctgtagagtcactacatcgtgtcacgtacaggttgaggacatccccgtgcatataatcccatgcgctgagtcccttggcggagaacacattgaggctcgcgagagagggggaatccagcatgagagacttgaacaacgttgcaagcctctgtggcaccattatcggtccatttcaacgtaggaaaagtagacccagacctggttgaacggaagcgtgcccaatcactttgccaatggactatgcaatagtatagacacgattcaccgagagggatatccaacatgcggatcgcaggcccttcggacggattaggaacaccgtaagtccacagggctgacgcactaatgacaatgggccacaataaacgagtcctcgtgttgtcacattgtgcgtcacctctcttacaacaggcaggggtatcacgtgtacacgcatctacaattacccacggacccaggtaggaaattgcattagcatttgccaagaaccatgcagagtaggagccgttccactaaatggctgatgcagacccacttcgcgagcacaggt

SEQ ID NO: 83284 - DNA, 247 bp, Homo sapiens
tcggaaggagaaggagaagagaggaggggagggagaggggaggaaaggaaggaaggaaataaatgaagcattttgtatctactgatggaagggcacaccatctcccctgatccactcttactaaaagagaaacagtcaaacctgaatgtgatgaggccgttctctctccactcccgggagtggagagagaaagcagggtgttttttctttcttttttttttccttaaagacggagtcttgctgggta

SEQ ID NO: 83285 - DNA, 1016 bp, Homo sapiens
tgctgaaagctgcagagatgatggaaagatgacagggagatgatgggacgaccagctgcagagaggagctaccctctctactgatagctgaacacttgttgggacgacttgcctaaccctttctgctaggagctgaacagacgttgggacaccctggctgcagaaaggagctgcccccctgtgggtttcctcagagctgttctgtcactcaataaagctcctcttcatctggctcactctccacttgtctgcttacctcattcttcttggacaagaactcaggacctgccaaatggcgaggctaaaagagctgtagcataaacagggctgagatgtaccctttgcttgccacattacaggtgaagtgaaggagagaagagctgcagccctttggggaacccagacctgggagctccccaagccagggctgtgattccttctttggggccctgtggttcctggtgtctctaaacttttgggtgccaccgtgttccccagtgccagctgtggaagctgcttgcagtgtgcttggtctggccgaagcctcacagggagccggcacctatagctgcttgccctgctgaagcagctggcacgtctgtgtgcagtggccagaccccacgcacgctcaaacacgcctcgccattccacgcctgactcgcccttggtaggcatgggactcaggcctgtagtgtgagcctagtgcagcctgccaggccaagtgggtgagatgagcccagcaggcctgagcaaaggtgccccagccacagaggttttggccagaaaaacgacagcctgaagatctcgtaacacagcggcattttctctcccagtttgcagtgctcccccatctcggtgctgtggggtctgcttgcagctcagcgtctgttcgagcccatctgttcacacgctcctgtcatcctcctgtgtctgtgaagtcttaaacctttagttaagtcaatacgtgttcggtgagatgcgattctctatttcattcactaaatcaagactagctg

SEQ ID NO: 83286 - DNA, 1143 bp, Homo sapiens
  misc_feature (44)..(44): n is a, c, g, or t
  misc_feature (47)..(47): n is a, c, g, or t
gtactgccaggacatatgggggaaaatttttttgtttgtttgtnttnttaaataaaaggccaggtgtggtggcttatgcctgtaatcctcccaaagtgctgggaggaagtttctttttatagaactattacagctaatacatgaggaaggaattataaaattataatgttacaaatttgtatttaagccctaataaatcaatgaatctaggcattgagcatcatgaatactaatattaccagaagacagccagacacatttgcttcctgatgtaagacagtaccacgtgtgaagtggtctctcccacccagacagttgaatcttaatcagatcaaacatctaaattcacctagtaacttaagggaaatactgaagatgaaaatagtaaagaatagcaaggagatacaactttgctgttagtagcaagaaaaattgagattgtgggacactgtatagcacagacaactagtttcttcctccctccacaaaatctcaaggaaaaaatgtgaggggacatattttaaaattttaattaattaaaataaaaatttagatcctcatttgcactagccacatttcaagtgctcaatagctatatgtatctagtggctaccatattggacagtgctgatttagaacatttccatctttgcagaaggttatattgagcagttacattagtttcttaaggctgccataacaaattactacaaaatgggtgacttaaaataacaaatttgttccctgacgcttttggaggacagaagttcaaaatcaagatgttgcaaggtactggcaggacatatgggggaaaatttttttgtttgtttgtttttttaaataaaaggccaggtgtggtggcttatgcctgtaatcctcccaaagtgctgggaggaagtttctttttatagaactattacagctaatacatgaggaaggaattataaaattataatgttacaaatttgtatttaagccctaataaatcaatgaatctaggcattgagcatcatgaatactaatattaccagaagacagccagacacatttgcttcctgatgaaagacaccccctggtgaaagggtttttccaccccaaaaggggaatctttatcagaacaaaacttttaaattccccttggac

SEQ ID NO: 83287 - DNA, 1609 bp, Homo sapiens
  misc_feature (44)..(44): n is a, c, g, or t
  misc_feature (47)..(47): n is a, c, g, or t
gtactgccaggacatatgggggaaaatttttttgtttgtttgtnttnttaaataaaaggccaggtgtggtggcttatgcctgtaatcctcccaaagtgctgggaggaagtttctttttatagaactattacagctaatacatgaggaaggaattataaaattataatgttacaaatttgtatttaagccctaataaatcaatgaatctaggcattgagcatcatgaatactaatattaccagaagacagccagacacatttgcttcctgatgtaagacagtaccacgtgtgaagtggtctctcccacccagacagttgaatcttaatcagatcaaacatctaaattcacctagtaacttaagggaaatactgaagatgaaaatagtaaagaatagcaaggagatacaactttgctgttagtagcaagaaaaattgagattgtgggacactgtatagcacagacaactagtttcttcctccctccacaaaatctcaaggaaaaaatgtgaggggacatattttaaaattttaattaattaaaataaaaatttagatcctcatttgcactagccacatttcaagtgctcaatagctatatgtatctagtggctaccatattggacagtgctgatttagaacatttccatctttgcagaaggttatattgagcagttacattagtttcttaaggctgccataacaaattactacaaaatgggtgacttaaaataacaaatttgttccctgacgcttttggaggacagaagttcaaaatcaagatgttgcaaggtactggcaggacatatgggggaaaatttttttgtttgtttgtttttttaaataaaaggccaggtgtggtggcttatgcctgtaatcctagcactttgggaggccgaggtgggcggattgcttgagtccaggagttcgagaccagccttggcaacgtggcagaatcccgtctctactaaaaatataacaagtagccaagagtgatggcatgtgcctgtaatcccagctactcggaaggctgagacagaggttgaggtctcagtgagctagaggttgctgtgagccaagatcatgccactgccctccactctgaacggaattagaaaacagttaatttaaaaattcgatattctgtgtgtgtgtgtgtgtgtatgtatgtgtggagagagagagacacacacacacagagaggtggagacagcgtttgtagctttgtgtgtgtgttttggctgttgaaattgttttgaatccagtatttttgagctgaagtttgtaaaattcaacaaaaggaaaaagtaatctgtttttggcaattgagtattggctaaacgttagaaatgtgtttgttcatgtttttaatatcttatgtatactgatgttaggatacttctatagagcttctcaaattgtagcacatatcagaatcacctggaggatttttaaaaacagactgcttgacttcatcctcagagttttcaacttactggcttggagatagggcagacagaatttgcatttctaacaggttcatatgatctgatgctactggttgcgggaccactctttgacaaccgctgcacaataattaaaaaaattaaaa

SEQ ID NO: 83288 - DNA, 296 bp, Homo sapiens
tagtagagccggggtttcaccgtgttggcaaggatggtctcaatctcctgacctcgtgatccgcctgcctcggccccccagagtggtgggattacaggcatgagccactgtgcctggccctaatttctccaactctcatcaacgcgtgttattgtccatttttttgataaaagccacctgcatgggtgtggagtggtatctcattgtggttctgattttcatttccctatggttagctatgttgagcatattttcatgtgctcattggccatttgtatctcttcttttgagaaata

SEQ ID NO: 83289 - DNA, 491 bp, Homo sapiens
cccaaaacaggctgactaggggcctactgcttcccaactaccagctgagggggtccgtcccgaaaagggagaagaggcctaagaggaaacatcaacatctttttactcctagcgagcggcattctgtgtgccttgattgtcttctggaaatatcgctttcagggaaacaatggcgaaatgtcatcagtttcaactgcttttgcactactaagacgcttttctgggttaattagcagcaatacagacaacgatcttttattcaacaacctctctcgagatattttaaataatttctcacactcgaaaaacatgcagaagcgactattggcaaacctgaagagggtggaataccaaatggctgaactggaatattttctagttagcgagggtttgagaggtgcgtcaggtctccagaaattcacctcaaaagcgtacaggatgtaatgccagtggtggaaatcattaaagacactttgagtagattcatttga

SEQ ID NO: 83290 - DNA, 777 bp, Homo sapiens
gctttaatgtgttgttgaggttgatccattgtaacatgttatcactacttcattcctttttatagctaagtatactttttatagtaagtatgccattgtagatatataccacaagtttatcgattcatccagttgagttgtttctactgtttggctaatgttcatagtgctgttatgaatgttcgtgtacaagtatttgagtccgtgttttcaattatttggggtatatgcctgggagtggagttgctgggtcatgttgaaatcgcacatttaactttttgaggaactgtcaaactttccctcagcagctgtaccgttttaccttccaccattgatgtatgagggttccaatttctccacaccttcaccaacacttattttgccattttaaaaattatagccatcctcatgggtgtggtctctcattgtggttttgatttgcatttccctgattactaatgatgtggagcatcttttgttgtctttggccatctgcgtatcttctttgaagaaatgtctgttgaggtcctttgttcattgaaattttgttgttgggttctgagttccttatatattctgggtactaggcccttataatattttcgcctataagtttttgctttataatgtcctcattgttttcaaacttactttatgtaatatgtacacttctaaaaaaaagaaacatggaaaagggcaaactgtaagaagttttttgtgttatgttttttgtgacagtctgtgcatatatacacaaatataatgtatgttctctcc

SEQ ID NO: 83291 - DNA, 615 bp, Homo sapiens
taaatgtaagtctggtcatttcacttctctgctaaaaaccttccagtgacttccccttttaccgagaataaaaaggtagtgatttacagtgatctttaagaccctacctacacagttgcctgcccctattctcttgagttcatatcctactagtttcttccttactctctatgctacagtaacactggcctcctttttgttcctcgaacacacagggtatgctcctatgcatgcactggctatttcctctatctggaatactctttcccctagataccacatgactcactacatcaccttctttagctcgttgatgaaacgtcactttgggcttggccggtggctcacctgtaatcccaacactttgggaggctgaagcaggagaattcacttgagtccaggaattcaagactagcctgggcaacatgatgagacctcccctctacaaaaggtaaactaaattagctgggcgtggtggtacatggcggtagtcccagctgctcaggaggaggctaaagtaggagaatcacttgagcctgggaggctgagggtgcaatgagtcatgattgtgccactttactccagcatgagtcacaaagcgagaccctgtctcaa

SEQ ID NO: 83292 - DNA, 805 bp, Homo sapiens
ggaagcagggcagccatgagccttcaggaggaggccgagcccaccccaagccccccgtcccctaatagggagtccctggcgctggccttgacagcagcccacagccgaagtggatctgagggccggactccagagagggcgtccagccccggcctgaacaagccactgctggccacaggggatagcccagcaccctctgtcggggacctggccgcctgcgccccctcacccacttcagccgcccacatgccctgcagccttgggcccctgccccgtgaagacccacttacctcgccttccagggcccaaggtgggctgggggggcagctgccagcatctccgtcctgcagggaccctcccggcccccagcagctgctggcctgttctcctgcctgggcacctctggaagaggcagatggcgtccaagccacgacagatactggggctgaggattccccggtggctcccccgtctttgacaacaagcccctgcgatcccaaggaagccctggctggttgccttctccagggggagggcagccccctggaagacccttcctcctggcctcctggctccgtcagtgctgtaacctgcactcacagtggggacacccccaaagacagcactttaagaattccagaggattccagaaaagagaagctgtgggagtctcctggccgagccacctctcctcctctggcaggggccgtctcccccagcgtggccgtcagggctactggcctgtccagcactcccaccggagatgaggcacaggcaggcaggggactcccagggccagaccccc

SEQ ID NO: 83293 - DNA, 508 bp, Homo sapiens
ctctggaaatttaatgtaatttgaatttttatggattcactactgttaggtgtattaaagttgcaatgaactgtagtgaatgtttttatattgtaagtaacttccaggttacctgcttttaaagttcctgtttttatttgtcaacttttcttaaagtgaggtttgcccgttccttttgttgtcatcttctaaagttttgatcatttgaattaggaaaatttttccatcttgttgtaaagcttgctcctgtgtaaaccatagacttttttttttttttgagacagagacttgctctgtcacccaggctggagtgcagtggtgctctttctgctcaccgcaacctctgcctcctgggttcaagcgattcttctgcctcagcctcccaagtagctaggattacaggcatgcgccaccacactcagctaatttttgtatttttagtagagacagggtttcaccatgttggccaggctggtcttgacctcaggtgttctacccgcctcagcct

SEQ ID NO: 83294 - DNA, 505 bp, Homo sapiens
ggcagatacggaagccagtgcgtcagggtcagaggctgcaaagctggaggagaactggggcgtctgctgggcgtggcgatgaaggggctggtgtgccaggtggacagaatgccagggagagcggggaaggaacagtgctcatgtggccccgccatgttcagccaggattcataaagaaagtggaaccaggatatcatggtccacctctttagggaggagagggatgagcggtgagaggtggtggtgtcacctgcccggccagccgtccccacagcttctccacctccgctcccactcggccaccccttccttcccctcctctccatggaggaggcctccctgcttttagctttgcctctcccacccctcactggcaaggcaccgtccttgggattagaaagatgaaaaggccaccgccatcacggagggaatggacaacggataaaaccaccagctcctggaaaaggacgtgcagcggctcccagagccttggcaagccaacacc

SEQ ID NO: 83295 - DNA, 577 bp, Homo sapiens
agcgggcggggcgggcaggggttgtggcgcggcaagcggcgggccagcgacggcgcgaatggcggactctcagctgttctgtgtggcggaggaacgcagcggccactgcgccgtggtggacggaaacttcctctacgtgtgggggggctacgtggtaaggggaagaggcgggacggggtagactcgcgccgggagaccctcggcctgagcggacgcagcgcccgccacacccgctcccgaggctgcggcccaggcctggcgcgcccggcgcctgcagccccccagcccctccgctggccgccgcccccacagccgcgccagggcttgacgtcgtcccgccgttgcttcttctattaaagcctcagacccggctccgggcctcttaacactctccgcccctctttgccagcaattcagtaaccacggtttgcccaatgcaaaggcagttacagcgcgattaattattatccttaaatactggcgcagacctagaaggacccgaggacgccgtgctgtatcattttgtatatatttccttattcccacggcgcgattcgaaataaaatatcgaaatcac

SEQ ID NO: 83296 - DNA, 462 bp, Homo sapiens
agaagctgtgtaactgtttgctgtgtaactgataaacataattttatgtattctgtatttttagtctattgaagacaatgaagtatatttgcctaatgatgaaatttggacctatgatattgatagtgggttgtggtaagtaattttaaattgcatactgtctgatcttaatatctattataaatgtttctgtagactctagggaatttgagaccatactttgaacatactgcaacatttttgaagtctccctttcctttcctttcaatgcttttattttctgactctttcattcccctactgtcttccctgctccactttttgtcttttagtatttctctcaagaccagtgctgtctctgaagattttgttttattctgcaaatttccagttctagtgacgtgtgaaatttttgtgatttttttttttttcctagcagattgaaaaagttttaccctggat

SEQ ID NO: 83297 - DNA, 837 bp, Homo sapiens
  misc_feature (773)..(773): n is a, c, g, or t
  misc_feature (775)..(776): n is a, c, g, or t
  misc_feature (784)..(784): n is a, c, g, or t
  misc_feature (796)..(796): n is a, c, g, or t
agcgggcggggcgggcaggggttgtggcgcggcaagcggcgggccagcgacggcgcgaatggcggactctcagctgttctgtgtggcggaggaacgcagcggccactgcgccgtggtggacggaaacttcctctacgtgtgggggggctacgtgtctattgaagacaatgaagtatatttgcctaatgatgaaatttggacctatgatattgatagtgggttgtggagaatgcacctcatggaaggagaactcccagcctccatgtcaggaagctgtggtgcttgcattaatggaaagctgtacatttttggaggatatgatgacaaaggatacagcaatcgactttattttgttaatttacgaacaagagatgaaacctacatttgggagaaaatcaccgactttgaagggcaaccacctacaccacgtgataaactttcctgctgggtatataaagacagactaatatattttggtggttatgggtgtaggagacacagtgaactccaagactgttttgatgttcatgatgcatcttgggaagagcagatattctggggatgacataatgatgtccacatatttgacacaaagacacagacttggtttcaaccagaaattaaaggtggagttccaccacagccacgagccgcgcatacgtgtgcagttcttggaaataagggttatatctttggcggacgtgttctgcaaactaggatgaatgatttgcactatctaaactagacacctggacttggtctggaagggattncnnttaatggngaaaggccaaanaattcggtcatggctaactttaaacactataggtggtgata

SEQ ID NO: 83298 - DNA, 676 bp, Homo sapiens
tcccttatccagccctagaatcagttattttccaaggagccctggtttctttcattgaagagtggtttttggaaagccaaatctatgcacaagtgtgctcattgctactgggtggacactgcttctaggccttctcagtggacagttagaaaataaatgcgtgtatttctgtgtacagcaagtccttacttaacatcaataggttcttggaaactgcaactttaagcaaaatgacatataaagaatcaaatttttttcttttttttccttaggacctcatgatgcaacagtagaaaccaaatttttttcatgaacagtctaaaaaatgacatttaatgaaacattatttgaggacctgctgtatattgtttcctttaaagtcgcaaagtcttgcaggtgctgtggctcttgcctgtaatctcagctacttgggaggctgaggtgggtggatcatgtgaggccaggagtttgagatcagtctaagcacacatagggagactcccatctctagaagtcattaaaaaattagcagatgtggtggcacgtgcctgtagtcccagctacttaggaggctgtggtgggatgatctcttgagcccaggagttggaggctgcagttagcatgatatctagtgcactccagcctgggtgatagagtgaaaccccatccctgaaaa

SEQ ID NO: 83299 - DNA, 318 bp, Homo sapiens
cctccccatttcaggcaattctcctgcctcatcctcccgagtagctgggattacaggtacccaccaccaggcctggctgattttttgtatttttgggtgaggccaggagtttgagatcagtctaagcacacatagggagactcccatctctagaagtcattaaaaaattagcagatgtggtggcacgtgcctgtagtcccagctacttaggaggctgtggtgggatgatctcttgagcccaggagttggaggctgcagttagcatgatatctagtgcactccagcctgggtgatagagtgaaaccccatccctgaaaa

SEQ ID NO: 83300 - DNA, 454 bp, Homo sapiens
tgggttcaagccatcctcccacctcagcctcctgagtagctgggactacaggcatacacccaccatgtctggctaaaatttttgtactttttgtagagacagggtttcgcccatgttgccccaggctggtctctagctcctgggctcaagcaatctgcctgcctcagcctcccagaggcctggaactacaggcgtgagccgctgctcttggccatttttaatttaagggacagagtctcgctttgttacccaggctggagtgcagtacccttactgcagccttgaactactgggctcgagccgtcctcccgcctcggcctctcaggtagctgggactacaggtgtgtgtccccatgcccagctgactgagctaccaaccatgccactgcatgccagttgtgacaaagtgagaccctgtctctaaaaaataattaaataaaatgtttaatggtgt

SEQ ID NO: 83301 - DNA, 1861 bp, Homo sapiens
actcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttgaaaaagccaaagtgtacggtagaaatttctacaaaatgaatattatcaagagtttcatgtgatcactgcagtgttgtcacagctcataaatagcaacagtgtttcatgatttaatggctcagaaatagttattcattagtttttaatttttaatttctaaggtacagagatctataaaaccttgattatttgttagttttgcaattcaaaacagctaatgtctggttatttctcaaagtaagtattttaaacagcctgttaattataagaaactcagaataatgagtgtaaatgtgttatgttatccacccaagtgtacatatgtacctatttttttttaaaaagcagaaatagaaatacaagactggtaaacatgcctttaaaaatatatatattttcaactagtattgtctataatgctgaaatattacttattggtgatttttctgtttcacacactctaaaatataagtaaagccaaccttttttttaaggctgagattcccaaaatgagaatactactttataccatttgtttataagtatgaactgttcttataaatattaatatttacatattcactaatttaacataaatgaaaattaggattaaaaattgcaccaaagcatcggcaaaaacaatactatattctttaaaagtgctcaggtagccaaggcccttgcttttggtatcaaccctcatgaacccataggagctgaatatttgtttcactgcttaataatcctcaatttacactattcataactcttaaaattattctctttttttctaagagcccctcccttccaaaagtgtatttttttcaaagattttcacttctcaattgttgcctttgtacatactatagagtgttgcttgtaagaaaggctaatatggaaccaaactcttgtaagtaatgtaaatagaaaggtgggtggataaagttttcaatactttctactacctcagtttacttgagtactacattatagtttattctttgcttatctggtctaagagacttttaatgctagtagtaaagttggtttctgctttcattgactattttcatcataatttcatcattgattaaaaaaaaaaaccacttgtttattcagttattaaatatatttactatataacacatccattcttgctgtttaaattttcaatagttaatggaaagttgtctttgaccttgaatttacagcattgggtcacattttgccttgctgtgtatgtattcaagagacttccaactagacaaagaaaaaattgttgttttaatggaatgtaaacctgaaattggtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtacctttttttttttttttttttttttgacggagtttcactcttgttacccaggctggagtg

SEQ ID NO: 83302 - DNA, 840 bp, Homo sapiens
ttttagtagagatggggtttcaccagcctgggcaacatggtgagacaccatctctacaaaaaatttaaaacaaaaaaattagctggacatggtggcacatgcctgtagtcctagctactcaggaggctgagtcaagaggatggcttaagcctcggaggtcgaggcttcagtgaaccaggattgtgtcactgcactccagcctgaacaacagagcaaggcctcaaaaaataataaataatagcacataacaattaaccaccttttgaattgctctaattttatttttgaggatagttaacaaatatttagctttcatttgggtcaggaagaataaaagacaataaatccttaggtgtaaatgaatagaagaggtcaaactttgtgatttatttaaatagtagtagttacaaaaggccagttacataactatctctaaaaatattaaattgattcccaactgtacttatttttttcttatctctcaaactatcaatagattcatttaatcaatatttaatgtgattgaggacacccattatgtgcttaggattatgctaaatattaatactaaggtaaatataaaatagtatagtatatggtccctgccttcaagaaacttgcattctagctggagagacaaaaagatacatactttttaaaagttaagtaacccgaaggtccatcaacagcagaatggataaaaatgaatcatcaaaaaaaaaaaagagtcatccatttgtttaaatgagtataaatatgttttctatacagaatgaaaatgaacattgttatacaacatgtatatttctcacattatgttcaataaaaaaagccaaacac

SEQ ID NO: 83303 - DNA, 211 bp, Homo sapiens
gtcttcatgtgtttataatggttaatataaattttaggaaatagaataaaaaataaagcagctcattaagagctatggccatggtgagtacttaacatattggtgagatactgtacaaaataagcagatggctggatgcaatggctaattcctgtaatcctaacacttgggaggccaaggtaagaggattgcttgggcccaggagttcaag

SEQ ID NO: 83304 - DNA, 1894 bp, Homo sapiens
tggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcacaatgcatagaaacaaaagcagtttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccggatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaatttttgtgtaatgcatcttgaagaccggttgcaggagctatacttcaaaagtaaaatgctgtctgaatacctgagggggcagatgcgtgttcatgtcaaggagctgggagtggttctgggg

SEQ ID NO: 83305 - DNA, 456 bp, Homo sapiens
ggtctttctgaaactcttattagtctattcatttttctgtataggttccctaaggttttctacacacaggctcatgttatcagtgaacagatagttttaaatctttcttaacaatctggatgccttttgtccccgctgcccccaacttttttttttttttttgactcattgtactggctagaattttcaatacaatgttgcatggaagtggtgaccatggacatcgttgccttattcctgatcttaggggaaagacattgcatctttcatgattaagtatgttgttagttgtaaggtttttgtgatgccctttattagatggaagaagttccctttttatttttattttgtttaaccgaatacttcttttagagacaggcagttctcttttattcctagttttgagacggtttggttttttttgtccatcccttaatcatgaatgagtgtgggatt

SEQ ID NO: 83306 - DNA, 451 bp, Homo sapiens
ccttacatttttggtcatactttttacaacacaatcattgttctctgaatccatcattttatattcagtgcccgtatctttgtatctgtcactgtgaaagcaaataaagttccagaaatctatccacatggatatctgaaatacagaaagtactttatgtattcatggatgtccatcaactaggttatttatagtatcaaaaatttgcaagtgcttaagtttgaatggaattattttcttaatttccttttcagattactcattgcttacatatagaagtggggttggcttttgtgtattgatcttatatcctttggtctttctgaaactcttattagtctattcatttttctgtataggttccctaaggttttctacacacaggctcatgttatcagtgaacagatagttttaaatctttcttaacaatctggatgccttttgtccccgc

SEQ ID NO: 83307 - DNA, 386 bp, Homo sapiens
ctaaataaatgtcttttgggggcatttttcttccaggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcaggtgagtgaccttcactgtttttgagtttatttagaagaaactctgttaagcagcagaacccaaaattgccttacatttttggtcatactttttacaacacaatcattgttctctgaatccatcattttatattcagtgcccgtatctttgtatctgtcactgtgaaagcaaataaagttcc

SEQ ID NO: 83308 - DNA, 404 bp, Homo sapiens
ttattagagacgaggtttcaccatgttggtcaggctggtctcaaactcctgatctcaagtgatccacccacctcagcctcccagagtgctgggattacaggtgtgagctaccgcgcccagcccgcacctgcagcttaatcccatttcgctggtgcaacttcatccttccgtatgctcaggccaataaacagtactgtaggctggtcgttctttgacccccatacatcctattggtcggaaaattatgttttctctttggttaaccgcagactttgatatgcacactctttcttggtctgaaacccacccaatagtcccatacgtagatttttggataaacatagaaatggacccttctgatctgaaagtttgaaactcgatatttgttttatttgagttccttc

SEQ ID NO: 83309 - DNA, 146 bp, Homo sapiens
ctgtgctagaccaaactgtttaagcagacgatgtggaatgtgtgttaacgtttccttgtgggcactgtagtgacaaactattttttatttttattttttttgagatggagtctgtcccccaggctggagtgcagtggcaagatctg

SEQ ID NO: 83310 - DNA, 1052 bp, Homo sapiens
ttttttttttttagtagagacgcggtttcaccgtgttagccaggatggtctcgatctcctgacctcgtgatccgctcgtctcggcttcccaaagtgctgagattacaggcttgcaggcgtgagccaccgcgcccggccgagttaaagtactttttctggaacaaagaaacttagcataaatagttaaaatattaagagttgtaattaagggaaatttcagctcaatatgacttcaacagtttaaaaaatgtattatttcacataagaccatggagagaggaattggaagccccagaattgattgggtcagaaattgaaaatgatactatcagtgacccaggtttgaatgtctctctccacagcattgacttcactaatggatgtgacctggttggcagcagtagcttgcacaacatgcttgtttgcagtgagtagtagagagaaggttttgctttcccagaaactctgaaaaaggtcatcaaacctaaatttccttagccttcttcttccatgagcaaatcactagcagatgattgctagcaaggtgttactattacaatgaacccctaagtgtcagagaaagagttagtttggggaaatatcctctccaccacaatcttagtcattgaagtcaatttaacaatatattgaaatatttttcttagaagtttaaagttccattaaagagtaacaattacagaaattataggtagcctttagttctacaagtgacatctcaaaagggagatgattcatcaatttcaaactttccctgcaagtaatactggatgaaaattaacttggcaaacataattaataatcatgggttattaattacttctgcaaggtgggtgtgctgattttaaaaggcttgaataaaacataaatttccttaatttgatactgtaaatggagtaatttggtgatgtaaatggtaatatgtaagggatttttgcttcagatcttacaacttaaaatatttttctaaaattagtttttgtaccatctctccagcatgttccagcctttatcagtcagtccaggcttctata

SEQ ID NO: 83311 - DNA, 855 bp, Homo sapiens
ggactacaggcgcccaacaccttgcctggctaatttttgtatttttagtagagatggggtttcaccatgttggccaggttggtctcgaactcctgacctcaggtgatccacccacctcggcctcccaaagttctgggattacaggagtgagccaccgcacctggccagggaattatcttaagggcaatattcatttggaagtataagttaagatgtatgtgttaaatgtcttcagagctatttgtttaaaattattgattttttaaaaagcagctataactgcttcaactaatatatctccaaaaataattccctaatattatctataatacctagcccatattcagttaaccccggttatttataagatgacttttaagaagtatgtgagtcattatatttagctgtatggctcttagtcttttcatatctaaaataagccaacttaaatattttaaaaatcgctcttaaaaatatcaaagaaatgtagccagcacatcttctttataataaaaatcagaaagatatagaaagtagaaatatttttatagcttccatcattgtgagcatggatgccttcctgatatatttttctatctctatttacttccctatttgttttctttcacatggttgagttcattttgtatgcaattctccctttaataataggcagtgctgtatcttgctttgtaactttaatgtatttgtaacttttaatggctgcataatataccattaagcgagtgtaccacaattctgcaaacataattcaattttctgttaacatttaggattttccccaattgtttgtcatagttaacaataatgtaataaatacttattttgaaaaca

SEQ ID NO: 83312 - DNA, 730 bp, Homo sapiens
cttcgctcaaaaaagattaagaactaccaccgcacctggccagggaattatcttaagggcaatattcatttggaagtataagttaagatgtatgtgttaaatgtcttcagagctatttgtttaaaattattgattttttaaaaagcagctataactgcttcaactaatatatctccaaaaataattccctaatattatctataatacctagcccatattcagttaaccccggttatttataagatgacttttaagaagtatgtgagtcattatatttagctgtatggctcttagtcttttcatatctaaaataagccaacttaaatattttaaaaatcgctcttaaaaatatcaaagaaatgtagccagcacatcttctttataataaaaatcagaaagatatagaaagtagaaatatttttatagcttccatcattgtgagcatggatgccttcctgatatatttttctatctctatttacttccctatttgttttctttcacatggttgagttcattttgtatgcaattctccctttaataataggcagtgctgtatcttgctttgtaactttaatgtatttgtaacttttaatggctgcataatataccattaagcgagtgtaccacaattctgcaaacataattcaattttctgttaacatttaggattttccccaattgtttgtcatagttaacaataatgtaataaatacttattttgaaaaca

SEQ ID NO: 83313 - DNA, 486 bp, Homo sapiens
aatagatgagaaagtggaagcatagccacagatgggatagtttgctgaaggtaacacagcaaagacatgtgctgtgtccgcatgcatttcaactccagcagttccctgctgcccttcagtggtgtcctgagtatccagacaagtgaaatcagcattattgtctactggataccatccatctctgttatgcacacagaggaatatgaaaggctggcgacttggtccttaattactattttgagttagtgttgtgctttcatttctccccgctaggtaccttcattttcaattatgtcgttacctgtgtagccaaacagctcacttaacttccttttccacgacagccttgtgaggctggggcccctctctgactcacttgctgttgtattaccgcacctaatccagtgcctggccgatactggagcccaataaatatgcatgtgtgaattattatgtgccaattaaaaataataataaaagccaaaa

SEQ ID NO: 83314 - DNA, 263 bp, Homo sapiens
cactgcacccggcacttttttatacttttggattctgaatcatgtgagtgtattgccattaccagcaaattttgggaaaagcccactgcaaggatgagtgaagggccccgcagcaggttcctcctcacagcctccactcagggccaacagcttccacacagacgcatggacatgtggactgtggacgtggagcgaatgtggtggctgtctactttgttctcaggatacttctggacagaaaatcccagcatatgactaattag

SEQ ID NO: 83315 - DNA, 575 bp, Homo sapiens
tattactgtgattaatgagataattccccagaggtggggtagtcaggaagcagccatttcccaattggctggcatgtgctcagcaccacaagtctggcaacactatttggtgctgcctccttatgcccatcaggtaatgctggggtaaaagtacccaaggaaagggcttagaaagacaaatggccttttctgccaccaaatggaaccaactggcattgagaatcaagtaacatccagtatgatcctaaggtcttctgtcctaaacagactagctctgtaattctttgaccataatactactaggatgatggaacaaattgattttaccaatgctgaggtccctcaggctcccacgaaacctggctcaagaggagctgcttctactttacaagctctgttggctcactgcttgccactccaggctggccctgtggccttgtgctgggcccgagtgacatttgaactctggtcagtgagaacactgtgggcctcacactctttttaagttgcaaaataaatagatctttaagacattgagcagattttgtggatgtagctgagaatatttttgtcat

SEQ ID NO: 83316 - DNA, 827 bp, Homo sapiens
tctcctgggtctccgttctctgtttggttctctgtcctcctctctctgtgtttctaactcctctcccgtgctctctgccctctttctctagaaacctctccctgctgcctctctggggttctgctgcccccagcactgactctccctcttgggtgtgtgccttctgccctccctttcttgacttgtgcaggcaccatcctcccctccaggtatctgccctgctaatctctctctctctctctctctccccctctttgggactctgccaccctctcttgttaggtctcatccccacttccttccctgagtctttgtccccctccactgaaggatctgtccgtggctgggggcaatttcagtgccaaaagcacagctctcacattccttcccagagctgtgtgtctgtgtggatgggcctgtttgtgcatgtgagcacacgtgtgtgtgtgtatgggaggaattccacatccactctggcccctgctgtgattacacagagagagagggaaggagggagaggatggagagcggggagagtgagggagagagacagagcatgagagcaagggcgtgcaggaaacacaaaggacttttccccacctcctcctgtcctccgaagaaagctgagagaagttcctcatcatttcctttaggaaaggacgattggctgccaagaatctgttacccacagatattaaactgatcacaacccacacacgagcacacagaaaacaaaggcagtggcttttatttttccctctgagctggaagaatatcaacggttcccttatcgacttcaaagcaataaggacttaggagtgttgaga

SEQ ID NO: 83317 - DNA, 327 bp, Homo sapiens
tgtcttaaaaaagatactgtcatggaggtggacttaaactggaaaagagtgatatagccgaaataaattatatatacatttcattgttgcctaagaacagggatcatttgttctgtctcttacagtgtattactgtgcctgcattagaggctggcagtatgtcaggagctctgtctggggtttggttatgtagtctattttgtgaaggaagttaatgtttttggattgcattatgattgtcgcccaaaccattatcctcattataaaaatccttaaatgtgtttgcaattgcttattaaaagtctctggcaagaagagtttaattta

SEQ ID NO: 83318 - DNA, 926 bp, Homo sapiens
ctggccaccagagccagcagcggcaacgcccttccacactgtgggagctttgttccttcactcttcacaataaatcttgctgctgctcactctttgggtctgcactgccattatgagctgtaacactcacagtgaaggtctgcagcttcactcctgaagccagcaagaccaggaacccaccaggaggaacaaacaactcctgacgcgctgcctttatgagctataacgctcactgcgaaggtctgcagcttcattcctgaagccagcgagatgacgaacccaccagaaggaaaaaactctggacacatctgaacatatgaaggaacaaactccagacacaccatctttaagaactgtaacactcaccgcgagggtctgcagcttcattcttgaagtcagcaagaccaagaacccaccggatggaaccaattctggacaccgtttcaatggataaatcttatacttacaaataggaacattttaagcataataccctagtaaacagttaatatcccgtattctagaaaaaaagatgacaaactcagccattagttacatctgctaatacagtgatgactttgcagactctagtaaacggtttgcctatgtaaggagacttttggaagttgtaaaaaataaataaataaaaagacaaaacaaaaaaacaataacagacatacaagaaagagcacaaacgacaacaattaagacaaaaaagggggggggggagcaccaaaagaagcacccccgggggggccactattacaccggaccccccgtctgtgtgggaacaccgggggcccccagaggagggcccgtataaaaagcaggcgcggcgccggcggtaaacacaccgcgcgagggaacaccgccgcccggacctggggggaaaaccaccccgtgcgggcgaattggcgacacccatg

SEQ ID NO: 83319 - DNA, 1005 bp, Homo sapiens
cgcctctgcgcctggcccggcgactgcgggcgctgcggtccactgggtccgcctcttcccggcatgggtttctgcccagctcacccgctgtcagctggggtcctgctctggtgggaggaagaggctcagacgcttccctgccctctcgcctcaaccacctcgaggcagcggctcccaggatgtgcactttgacgactaaagctgagccggcgccgccacgaccttgggcgggtggtcggcctctgccctgagcaggaagtagaaagtctcagcagacccttcctgagggccgagcaacagtgtagtggcgtattccacatagcaaacaggtccccagacagtcccggtgtgcacacttccctgcttctgttcatgatgttctctgaacctgggatcacctttccccttcctcttacctgcccgatcctacttgtcctcccagattcagttttctgaagctcagagggacaccttgtattgctggatgataaaaacaggagcaaagtgatgaagtgctgacaaggcaacaatagaacatgagagattcactgctgtgtaggaagagatcttcggtgaccatgtagcctgaagctctcattttgtcatcgagggacaccaaaactcagaacagtgctaagctcctacatcctgttctggaaggacaatcctgagcacacgatgagccatataaacttcagactgacgctgagtgaaagaatgctggaaaagcatcacaggccagggcagcaaagtcttcaaggtcatccgtgctctgatgatgtcacgcttcttccctgtctggaagacatttccccaagagcataccaccaacatcagggaaatggaatccaactggtcgctgcaaagtttgctgagcacacagtgataaagatggcaagaaggtcctgagagaaacgcaatatttttgtgcagaatgggatgttctgcctttgtcccatgctttgaaatttaccacatgaaaaataaaattaaatactgatcatc

SEQ ID NO: 83320 - DNA, 2269 bp, Homo sapiens
  misc_feature (294)..(294): n is a, c, g, or t
  misc_feature (1561)..(1561): n is a, c, g, or t
  misc_feature (2042)..(2042): n is a, c, g, or t
  misc_feature (2045)..(2045): n is a, c, g, or t
  misc_feature (2072)..(2072): n is a, c, g, or t
  misc_feature (2129)..(2129): n is a, c, g, or t
  misc_feature (2176)..(2176): n is a, c, g, or t
  misc_feature (2201)..(2201): n is a, c, g, or t
  misc_feature (2213)..(2213): n is a, c, g, or t
  misc_feature (2224)..(2224): n is a, c, g, or t
ctgctcaccatttctgagccgatgaggactcacctgggctcctcactggtcagggaactgtggcccagccgcagagtgattgctttgtcaagaagggaaacatttacctttccttcttccctctgctctctcctaattaacaattaaatggaaggagttgaaaagacatgtcagagacttcaatctcctcccggcctgaggatgaagggggctcgaacctgaatgttctcttcgctgtggccagaacctagggggctggggttgctgccagctcgactggaggcctgcttccanccccaggctgtggtgaggggcctcacagatttcacaaacaggagggcggctgaccaagcgccaaactatttagacaaacacacaccctcccttcccgccagagtttgggctgatttctcccaatgctaatgaacagctcataagtattaatagactccttggcacctaggagtcaggcagagtaacttccagtgtgaattttggccaaggaccctgatgcagcctcaggatcttccaagcccctgttgagtccagggggcatgagacacacagggaggctggggctgctcccaggaagcaggctcacaagagccagacaggctcccacagacagcttttaggtcacagaaacctctgcctgccaggtaggcatgaacacagaaaccctcccaaatcctcagactgtggagcacactccaggtgagccaggatcaatccctggtctcagagaacacttagatgggggtgaaaagcaggaactgagagcttcccacccagcacctgtccctgctaccagctaaacctgtgtcggtcagtgcaggaattgtacaggtgatgctctgagcctgtgctgaggccatgtatggactgaggaaacctcactgtgtgtatgtaaagttaattcaaacctatttccctgagtgcttacatattttcataaggaaagttctgttaggagagctgcctgaaacaacacctctgcctgtgctcccactttctcccgctggtgtggggaggagaggctgacatcgctgggtccacgttcctctgccctgggtggggtattaatgctgccattcccacgctgcctgctgtttcccctcatcctcaggagggctggtctctgtgctgcaggcagctccaccaggcctgggagcatgacaccgtctgccaatgccttgcccaggtccactggcctcacccttccgcaggcctgcgccttctgtgactctctgcctcagcaatttctctggatttctttgtcctcaggaatgtgctggggccacaggcaggtcaggccaggctttctggggagtgaatgctctctgccagtggcggatggaactggtagacacgtcccccggattcctcgcctgcaagtgggatggtgccaggaaagttctacaccatccttcccaggtcccaggaggacaagcacagttgtccacaagggaaccaagaggatgttgaaaaatcctggttggatctgaacttggaaacaaatttgaggaatctattttacttaatcctactgaaaaattccctnatgagttaaagaagaacaaagtaaaagaagataaaaaagcagttggtacttgaaatgaagatcaaatcatcaagtcctatatgtcacccacagatctgagatcactgactcccagagacacccagtttctcagtgtcagtacacactgcctgggttagtaagcacaggctgagacctgggaggaattgatgaaccaaatgtgtctgggcttttcacttcctcggcatgagtcagccaagaaagcccacctctcctccccagcagcgtgcagggcctctgcagataaatgtgcaggatagcagacctgggtgtggtgctgcctggcactgagccagcccccagattctttggctgcagagtggcctggccaactcacacaggtagcgcccttttattcttggaaaaggaagcaccaggtggaaagggaggttaaaggagggaacacaacttttttccagacccctctgcccaggatgttaanggntgctggaaaatgcctttggtggctttnaatgtcacagatgacatattccaggatggatccagcctccactggacttggcccctntattttgattcctgcctttccccagcctcagccctgagcggcataanatctacacggggttagctgcaggtngaactcagaacncagctcctagncaagtagagtgaggcctatggcttcatcatcaaaatgtaaaattt

SEQ ID NO: 83321 - DNA, 943 bp, Homo sapiens
cgcctctgcgcctggcccggcgactgcgggcgctgcggtccactgggtccgcctcttcccggcatgggtttctgcccagctcacccgctgtcagctggggtcctgctctggtgggaggaagaggctcagacgcttccctgccctctcgcctcaaccacctcgaggcagcggctcccaggatgtgcactttgacgactaaagctgagccggcgccgccacgaccttgggcgggtggtcggcctctgccctgagcaggaagtagaaagtctcagcagacccttcctgagggccgagcaacagtgtagtggcgtattccacatagcaaacaggcagcatttcttcctgtgacaatatggtgtaagacaaaattgtggcctgccatgaagttgtgagagaaaagcatccctcatttcttcaggaaaggccactgccgttccctccggctcctcttctcaggagtttgtgcattcatgaggtgaattccttggaagatgagggccaagtcttattcttctcagtctcttctgcatctaacagaagaataatggttgcacagaaaatcttggttcagtggttgagtgaatgaatggatgaacaggctcttgcacacaaagaagagacatgatgtatttgcatccttccctgcttcagccagttttctgaagctcagagggacaccttgtattgctggatgataaaaacaggagcaaagtgatgaagtgctgacaaggcaacaatagaacatgagagattcactgctgtgtaggaagagatcttcggtgaccatgtagcctgaagctctcattttgtcatcgagggacaccaaaactcagaacagatagagtctagctctgtgacccaggcttgtgtgcagcggtacgatattggctcactgcgactccaactcccaggttcaagcaattctcctgcctcaggactccca

SEQ ID NO: 83322 - DNA, 628 bp, Homo sapiens
acccccagtgtatgctattctgttatggcagccctagcacactaatataaatgcctactgcctgcaaagtgctttgcctttgagggttgcaaaagaggatcccctccagggatccatggtctcattgggattttcctgtttggtctgtgtcctgttcttgagtctccgcaggcagcatttcttcctgtgacaatatggtgtaagacaaaattgtggcctgccatgaagttgtgagagaaaagcatccctcatttcttcaggaaaggccactgccgttccctccggctcctcttctcaggagtttgtgcattcatgaggtgaattccttggaagatgagggccaagtcttattcttctcagtctcttctgcatctaacagaagaataatggttgcacagaaaatcttggttcagtggttgagtgaatgaatggatgaacaggctcttgcacacaaagaagagacatgatgtatttgcatccttccctgcttcagccaggtaagatctactagctcagacttatcacagccctgtttctgagctggtcccacgaatagagtttttgtttttcaccagcaagcaggctgtttccaagctgggatgataattgttgatgtggcactttaaac

SEQ ID NO: 83323 - DNA, 886 bp, Homo sapiens
cgcctctgcgcctggcccggcgactgcgggcgctgcggtccactgggtccgcctcttcccggcatgggtttctgcccagctcacccgctgtcagctggggtcctgctctggtgggaggaagaggctcagacgcttccctgccctctcgcctcaaccacctcgaggcagcggctcccaggatgtgcactttgacgactaaagctgagccggcgccgccacgaccttgggcgggtggtcggcctctgccctgagcaggaagtagaaagtctcagcagacccttcctgagggccgagcaacagtgtagtggcgtattccacatagcaaacagttttctgaagctcagagggacaccttgtattgctggatgataaaaacaggagcaaagtgatgaagtgctgacaaggcaacaatagaacatgagagattcactgctgtgtaggaagagatcttcggtgaccatgtagcctgaagctctcattttgtcatcgagggacaccaaaactcagaacagtgctaagctcctacatcctgttctggaaggacaatcctgagcacacgatgagccatataaacttcagactgacgctgagtgaaagaatgctggaaaagcatcacaggccagggcagcaaagtcttcaaggtcatccgtgctctgatgatgtcacgcttcttccctgtctggaagacatttccccaagagcataccaccaacatcagggaaatggaatccaactggtcgctgcaaagtttgctgagcacacagtgataaagatggcaagaaggtcctgagagaaacgcaatatttttgtgcagaatgggatgttctgcctttgtcccatgctttgaaatttaccacatgaaaaataaaattaaatactgatcatc

SEQ ID NO: 83324 - DNA, 1173 bp, Homo sapiens
acccccagtgtatgctattctgttatggcagccctagcacactaatataaatgcctactgcctgcaaagtgctttgcctttgagggttgcaaaagaggatcccctccagggatccatggtctcattgggattttcctgtttggtctgtgtcctgttcttgagtctccgcaggcagcatttcttcctgtgacaatatggtgtaagacaaaattgtggcctgccatgaagttgtgagagaaaagcatccctcatttcttcaggaaaggccactgccgttccctccggctcctcttctcaggagtttgtgcattcatgaggtgaattccttggaagatgagggccaagtcttattcttctcagtctcttctgcatctaacagaagaataatggttgcacagaaaatcttggttcagtggttgagtgaatgaatggatgaacaggctcttgcacacaaagaagagacatgatgtatttgcatccttccctgcttcagccaggtccccagacagtcccggtgtgcacacttccctgcttctgttcatgatgttctctgaacctgggatcacctttccccttcctcttacctgcccgatcctacttgtcctcccagattcagttttctgaagctcagagggacaccttgtattgctggatgataaaaacaggagcaaagtgatgaagtgctgacaaggcaacaatagaacatgagagattcactgctgtgtaggaagagatcttcggtgaccatgtagcctgaagctctcattttgtcatcgagggacaccaaaactcagaacagtgctaagctcctacatcctgttctggaaggacaatcctgagcacacgatgagccatataaacttcagactgacgctgagtgaaagaatgctggaaaagcatcacaggccagggcagcaaagtcttcaaggtcatccgtgctctgatgatgtcacgcttcttccctgtctggaagacatttccccaagagcataccaccaacatcagggaaatggaatccaactggtcgctgcaaagtttgctgagcacacagtgataaagatggcaagaaggtcctgagagaaacgcaatatttttgtgcagaatgggatgttctgcctttgtcccatgctttgaaatttaccacatgaaaaataaaattaaatactgatcatc

SEQ ID NO: 83325 - DNA, 623 bp, Homo sapiens
cttttttatttttgagatggagtctcgctctgtcgcccaggctggagtgcagtggtgcaatctcggctcactgcaacctctgcctcccgggttcaagcaattctcctgcctcagcctcccgaatagctgggaccacaggtgtgcgccaccacacccagccaatttttgtgttttcagtagagacaggttttaccatgttggtcaggctggtctcgatctcctgacctcaggtgatccacccacctaggcctcccaaagtgctgggattacaggcataagccatctgcccagctggtctaagaaattcttttgtcaccctctaaacattgcagtgctaagctcctacatcctgttctggaaggacaatcctgagcacacgatgagccatataaacttcagactgacgctgagtgaaagaatgctggaaaagcatcacaggccagggcagcaaagtcttcaaggtcatccgtgctctgatgatgtcacgcttcttccctgtctggaagacatttccccaagagcataccaccaacatcagggaaatggaatccaactggtcgctgcaaagtttgctgagcacacagtgataaagatggcaagaaggtcctgagagaaacgcaata

SEQ ID NO: 83326 - DNA, 1185 bp, Homo sapiens
cgcctctgcgcctggcccggcgactgcgggcgctgcggtccactgggtccgcctcttcccggcatgggtttctgcccagctcacccgctgtcagctggggtcctgctctggtgggaggaagaggctcagacgcttccctgccctctcgcctcaaccacctcgaggcagcggctcccaggatgtgcactttgacgactaaagctgagccggcgccgccacgaccttgggcgggtggtcggcctctgccctgagcaggaagtagaaagtctcagcagacccttcctgagggccgagcaacagtgtagtggcgtattccacatagcaaacaggtgaattccttggaagatgagggccaagtcttattcttctcagtctcttctgcatctaacagaagaataatggttgcacagaaaatcttggttcagtggttgagtgaatgaatggatgaacaggctcttgcacacaaagaagagacatgatgtatttgcatccttccctgcttcagccaggtccccagacagtcccggtgtgcacacttccctgcttctgttcatgatgttctctgaacctgggatcacctttccccttcctcttacctgcccgatcctacttgtcctcccagattcagttttctgaagctcagagggacaccttgtattgctggatgataaaaacaggagcaaagtgatgaagtgctgacaaggcaacaatagaacatgagagattcactgctgtgtaggaagagatcttcggtgaccatgtagcctgaagctctcattttgtcatcgagggacaccaaaactcagaacagtgctaagctcctacatcctgttctggaaggacaatcctgagcacacgatgagccatataaacttcagactgacgctgagtgaaagaatgctggaaaagcatcacaggccagggcagcaaagtcttcaaggtcatccgtgctctgatgatgtcacgcttcttccctgtctggaagacatttccccaagagcataccaccaacatcagggaaatggaatccaactggtcgctgcaaagtttgctgagcacacagtgataaagatggcaagaaggtcctgagagaaacgcaatatttttgtgcagaatgggatgttctgcctttgtcccatgctttgaaatttaccacatgaaaaataaaattaaatactgatcatc

SEQ ID NO: 83327 - DNA, 1853 bp, Homo sapiens
  misc_feature (1145)..(1145): n is a, c, g, or t
  misc_feature (1626)..(1626): n is a, c, g, or t
  misc_feature (1629)..(1629): n is a, c, g, or t
  misc_feature (1656)..(1656): n is a, c, g, or t
  misc_feature (1713)..(1713): n is a, c, g, or t
  misc_feature (1760)..(1760): n is a, c, g, or t
  misc_feature (1785)..(1785): n is a, c, g, or t
  misc_feature (1797)..(1797): n is a, c, g, or t
  misc_feature (1808)..(1808): n is a, c, g, or t
cgcctctgcgcctggcccggcgactgcgggcgctgcggtccactgggtccgcctcttcccggcatgggtttctgcccagctcacccgctgtcagctggggtcctgctctggtgggaggaagaggctcagacgcttccctgccctctcgcctcaaccacctcgaggcagcggctcccaggatgtgcactttgacgactaaagctgagccggcgccgccacgaccttgggcgggtggtcggcctctgccctgagcaggaagtagaaagtctcagcagacccttcctgagggccgagcaacagtgtagtggcgtattccacatagcaaacaggtgaattccttggaagatgagggccaagtcttattcttctcagtctcttctgcatctaacagaagaataatggttgcacagaaaatcttggttcagtggttgagtgaatgaatggatgaacaggctcttgcacacaaagaagagacatgatgtatttgcatccttccctgcttcagccagttttctgaagctcagagggacaccttgtattgctggatgataaaaacaggagcaaagtgatgaagtgctgacaaggcaacaatagaacatgagagattcactgctgtgtaggaagagatcttcggtgaccatgtagcctgaagctctcattttgtcatcgagggacaccaaaactcagaacagatagagtcttgctctgtgacccaggcttgtgtgcagcggtacgatattggctcactgcgacctccacctcccaggttcaagcaattctcctgcctcagcctcccaagtagctgggattacaggtgaagaactaatgttgacggaagttaagcaacctttcccaaagtctcatagtggaatgtgctggggccacaggcaggtcaggccaggctttctggggagtgaatgctctctgccagtggcggatggaactggtagacacgtcccccggattcctcgcctgcaagtgggatggtgccaggaaagttctacaccatccttcccaggtcccaggaggacaagcacagttgtccacaagggaaccaagaggatgttgaaaaatcctggttggatctgaacttggaaacaaatttgaggaatctattttacttaatcctactgaaaaattccctnatgagttaaagaagaacaaagtaaaagaagataaaaaagcagttggtacttgaaatgaagatcaaatcatcaagtcctatatgtcacccacagatctgagatcactgactcccagagacacccagtttctcagtgtcagtacacactgcctgggttagtaagcacaggctgagacctgggaggaattgatgaaccaaatgtgtctgggcttttcacttcctcggcatgagtcagccaagaaagcccacctctcctccccagcagcgtgcagggcctctgcagataaatgtgcaggatagcagacctgggtgtggtgctgcctggcactgagccagcccccagattctttggctgcagagtggcctggccaactcacacaggtagcgcccttttattcttggaaaaggaagcaccaggtggaaagggaggttaaaggagggaacacaacttttttccagacccctctgcccaggatgttaanggntgctggaaaatgcctttggtggctttnaatgtcacagatgacatattccaggatggatccagcctccactggacttggcccctntattttgattcctgcctttccccagcctcagccctgagcggcataanatctacacggggttagctgcaggtngaactcagaacncagctcctagncaagtagagtgaggcctatggcttcatcatcaaaatgtaaaattt

SEQ ID NO: 83328 - DNA, 460 bp, Homo sapiens
ctcttttgtttataaattatccagtctcaggtagttatagcagtgtgaaaatggactaatataggattctcacccagtcagggtcatggatttcttttctggagcagaaatttttctcccatcatacatattttatgggaatgaagaaaggagaaggaactagtgttttgtctttatactaaagaaaaaaatgaaaagaatattaattaaaataattaggcaacaaaactggggagtataaacacaccatttttgatactggcaatgaaaacaaccaagtaaactggaagtgttagaaaccctttataaagggacacagtattagttcatagtgctgggatctatgaaaacacaaattccgataataagaaatatccattgtgtgtaagaaatttcaatatgtatgagtgaaagatagtttgagggttgtatgtatgtgtgtgtgtgtgttttaatacta

SEQ ID NO: 83329 - DNA, 1478 bp, Homo sapiens
caccgcctccatcgccggttgtgttcgcaagaggcgacctcagtttcccaggtggcgctgcggcagccagtccaaagtcggactttcaaaaccaacccgaagttttgaacccggcggcggcagttgtcactggcacaggtttggcgtggtggcgccagtgtactacttctggggaggtctcaaccaggttctggcaccttcaatccccacctgatatctgcgtatcatcacggtatcccgcttttcccccagttccccaagagcgtccttcctttccctagtcacaggatcgcagttttggtctgatagtgcatccacctaccccagtgttgcatccccacttccctctttccatctaacgtggtggcctttcctggggataccttgggtatcccccgctaggagagcaagcacaagacaccagggagccagacccctgccgctcccctgccacaggatatgaatacgagcctcagctggtttgagcagctggatgtgcttctcaacgctactgatggaaatgtggtccggaataagcagtggctgtatcctcttggggtctccacagagctcattggcctgtgcatctgtttcttctgtagcagtggctgtatcttcttggggtctccaccgcaggccagcaccaggagctgctgctgaaacagctggctgagggacgacaggctcaggttggcagttggaaggatctccattcatgttgtccaatctaagctgcctctgcccactaccttcaccatgtctgtttcttcatccagctcttaattcagtcttctggacagtaacagtagctgggaacttttatggaagccagatccccagaggagcaccctttctaacctggagcccagcatctttcagctccatgcccagagtcttaagcaagaggacctattcctttggggccccaaaatgctcctgaatgacctgtaaggactcgttaagaatagtaggatgaaggcttctttgcccaccctcccctccaaggccctgtttctgggctgcccgcccctaccttcttgaagtagctattatctgtcttatctactgaggcttttcactgcctgcccatccttgccccccatctcagctcactgcaacctccgcctcccaggttcaagcaattgtcctgcctcagcctcccaagtagctgggattacaggtgtgcgctaatttttgtatttttagtagagatggggtttcaccatgttggccagtctggtcttgaacttctgacctcaagtgatctgcccgcctcgccctcccaaagtgctgggattacagttgtgagccaccatgcccagcctatagctgtaccttctgagtgcaagctcagttgaacttggaaagtaatgggagttcccattctggtgagtagaatgaggtaggacactgctctagggcagtagtgctgggggatgcaaaggaggatgagatattctggtgggacttggatctgg

SEQ ID NO: 83330 - DNA, 1436 bp, Homo sapiens
caccgcctccatcgccggttgtgttcgcaagaggcgacctcagtttcccaggtggcgctgcggcagccagtccaaagtcggactttcaaaaccaacccgaagttttgaacccggcggcggcagttgtcactggcacaggtttggcgtggtggcgccagtgtactacttctggggaggtctcaaccaggttctggcaccttcaatccccacctgatatctgcgtatcatcacggtatcccgcttttcccccagttccccaagagcgtccttcctttccctagtcacaggatcgcagttttggtctgatagtgcatccacctaccccagtgttgcatccccacttccctctttccatctaacgtggtggcctttcctggggataccttgggtatcccccgctaggagagcaagcacaagacaccagggagccagacccctgccgctcccctgccacaggatatgaatacgagcctcagctggtttgagcagctggatgtgcttctcaacgctactgatggaaatgtggtccggaataagcagtggctgtatcctcttggggtctccacagagctcattggcctgtgcatctgtttcttctgtagcagtggctgtatcttcttggggtctccaccgcagaatagcactgctgtcactcctgcagtgctgtcgggaggagtcagagattatgcagaaggaattgaagttgctgcagtaccagttgagccagcaccaggagctgctgctgaaacagctggctgagggacgacaggctcaggttggcagttggaagatccccagaggagcaccctttctaacctggagcccagcatctttcagctccatgcccagagtcttaagcaagaggacctattcctttggggccccaaaatgctcctgaatgacctgtaaggactcgttaagaatagtaggatgaaggcttctttgcccaccctcccctccaaggccctgtttctgggctgcccgcccctaccttcttgaagtagctattatctgtcttatctactgaggcttttcactgcctgcccatccttgccccccatctcagctcactgcaacctccgcctcccaggttcaagcaattgtcctgcctcagcctcccaagtagctgggattacaggtgtgcgctaatttttgtatttttagtagagatggggtttcaccatgttggccagtctggtcttgaacttctgacctcaagtgatctgcccgcctcgccctcccaaagtgctgggattacagttgtgagccaccatgcccagcctatagctgtaccttctgagtgcaagctcagttgaacttggaaagtaatgggagttcccattctggtgagtagaatgaggtaggacactgctctagggcagtagtgctgggggatgcaaaggaggatgagatattctggtgggacttggatctgg

SEQ ID NO: 83331 - DNA, 1564 bp, Homo sapiens
caccgcctccatcgccggttgtgttcgcaagaggcgacctcagtttcccaggtggcgctgcggcagccagtccaaagtcggactttcaaaaccaacccgaagttttgaacccggcggcggcagttgtcactggcacaggtttggcgtggtggcgccagtgtactacttctggggaggtctcaaccaggttctggcaccttcaatccccacctgatatctgcgtatcatcacggtatcccgcttttcccccagttccccaagagcgtccttcctttccctagtcacaggatcgcagttttggtctgatagtgcatccacctaccccagtgttgcatccccacttccctctttccatctaacgtggtggcctttcctggggataccttgggtatcccccgctaggagagcaagcacaagacaccagggagccagacccctgccgctcccctgccacaggatatgaatacgagcctcagctggtttgagcagctggatgtgcttctcaacgctactgatggaaatgtggtccggaataagcagtggctgtatcctcttggggtctccacagagctcattggcctgtgcatctgtttcttctgtagcagtggctgtatcttcttggggtctccaccgcagaatagcactgctgtcactcctgcagtgctgtcgggaggagtcagagattatgcagaaggaattgaagttgctgcagtaccagttgagccagcaccaggagctgctgctgaaacagctggctgagggacgacaggctcaggttggcagttggaaggatctccattcatgttgtccaatctaagctgcctctgcccactaccttcaccatgtctgtttcttcatccagctcttaattcagtcttctggacagtaacagtagctgggaacttttatggaagccagatccccagaggagcaccctttctaacctggagcccagcatctttcagctccatgcccagagtcttaagcaagaggacctattcctttggggccccaaaatgctcctgaatgacctgtaaggactcgttaagaatagtaggatgaaggcttctttgcccaccctcccctccaaggccctgtttctgggctgcccgcccctaccttcttgaagtagctattatctgtcttatctactgaggcttttcactgcctgcccatccttgccccccatctcagctcactgcaacctccgcctcccaggttcaagcaattgtcctgcctcagcctcccaagtagctgggattacaggtgtgcgctaatttttgtatttttagtagagatggggtttcaccatgttggccagtctggtcttgaacttctgacctcaagtgatctgcccgcctcgccctcccaaagtgctgggattacagttgtgagccaccatgcccagcctatagctgtaccttctgagtgcaagctcagttgaacttggaaagtaatgggagttcccattctggtgagtagaatgaggtaggacactgctctagggcagtagtgctgggggatgcaaaggaggatgagatattctggtgggacttggatctgg

SEQ ID NO: 83332 - DNA, 1112 bp, Homo sapiens
tgcagggggccccaaaggggagtgcttttctcctggagcaatgcctggaggagctgagaaaggaactgcagggccttcagagccaggtgtgggagcaaacccaagcccaagcccaagcccagatgcaaacaggaccaggagaatgcagtactaccaatggccttcctcaggagctgcagactgaaatagcactgctgtcactcctgcagtgctgtcgggaggagtcagagattatgcagaaggaattgaagttgctgcagtaccagttgagccagcaccaggagctgctgctgaaacagctggctgagggacgacaggctcaggttggcagttggaaggatctccattcatgttgtccaatctaagctgcctctgcccactaccttcaccatgtctgtttcttcatccagctcttaattcagtcttctggacagtaacagtagctgggaacttttatggaagccagatccccagaggagcaccctttctaacctggagcccagcatctttcagctccatgcccagagtcttaagcaagaggacctattcctttggggccccaaaatgctcctgaatgacctgtaaggactcgttaagaatagtaggatgaaggcttctttgcccaccctcccctccaaggccctgtttctgggctgcccgcccctaccttcttgaagtagctattatctgtcttatctactgaggcttttcactgcctgcccatccttgccccccatctcagctcactgcaacctccgcctcccaggttcaagcaattgtcctgcctcagcctcccaagtagctgggattacaggtgtgcgctaatttttgtatttttagtagagatggggtttcaccatgttggccagtctggtcttgaacttctgacctcaagtgatctgcccgcctcgccctcccaaagtgctgggattacagttgtgagccaccatgcccagcctatagctgtaccttctgagtgcaagctcagttgaacttggaaagtaatgggagttcccattctggtgagtagaatgaggtaggacactgctctagggcagtagtgctgggggatgcaaaggaggatgagatattctggtgggacttggatctgg

SEQ ID NO: 83333 - DNA, 320 bp, Homo sapiens
actgatagtttcctgccattttgtgtcatcagtggtacttgggtcccagaaatggactggttcttactaagcagtgggaatgcagcaatgagcagtgagtatcactaaagagcggacccttacaccaattcctctcattgttgatttcaacaggttgttgcaactgaagaagatctcgtcccacccagtctgcgggagccatcccccagagcagacgggctagaccacagaatcgcagctcacattgtgtcccttctgccctcactctgtctctcagagagggagaaaaagaatcttcatgacatatttttatctgaaga

SEQ ID NO: 83334 - DNA, 391 bp, Homo sapiens
ggaacaggcggcctttcatactctctaaaggcccaaatttctggtctgtttgcactttttttttattgctgcttacaaagccagcaattcttgcttgagctcccttccccagcaaaataccttcctcggtatgatgagtaacagcgcatactactgctgtttgacctgtttgctagagcgtggggctctccaagcacttggtctgtgtgtgctgcctcttgagttatcatcacagacaacactgaactaaatgtgttgctgctactgaataacgcagagctccggctgctacgcctactgctagaccatctgtttacccagggttttttattaggttaatatttccctctagatactgacatctgtatcaattaaactgatacttgctgct

SEQ ID NO: 83335 - DNA, 448 bp, Homo sapiens
taatgaactatagggatattttgatggactgttctttggaattaacaggtccacaagccagtggcttttctggaaattactgaaagctaattcttcagaagagtatgttctagctaagggtgtactataaaggtggtaaccagtagctagcaataacaagcttgttgttggtttcactgcagaaaatttaccacttgcatgtacttactgcattggtttaccctcaagaaaaagaaatacagcctctatatacctcttacacccactagatagaactaatcaggatctcttttgatcactggagcagataagcaggaaatataactaaccaagattaatttcacatattatctattattatagtttttcctaatctaccccttgacttaatctaattattttcagttcagggagcttcctgaaaatggaggacaaggatacatttcac

SEQ ID NO: 83336 - DNA, 810 bp, Homo sapiens
caaatgggcctgtttagttaaggctttgtgtgaagtatgtgggaagtgggtttcactttcaagaaggcagcatggagctggggcttggcctctgctgtctggtatagaggagcctggggatcaggtgtagctgcagacacagctgggcgcagagggagtggcctcatttcccagccacctactcctgccgtgcctcactcgccggggaatgtgatgtgtaggtcttgagaagaaggcccaggtcctgcagcccggtgaaaagacaactgtggcctaccacgaggccggacacgtggtggtaggctggttcttggagcacgtggaccccctgctgaaggttggtcctcccaccctgagtgagtccacctggcaggcttgggcctggtatctctgggccaacctgtggtcatgtgggcatggtacattcaaggattggccctttagctttttaaggaataaactgctctagaatttgtcaaaagatcccttcggggtgggaaagcagggcagtgggttccaaatggggccttggccatgcgactccagggagcagcctcagtgttaaacccgcctgactcctgagctctggattcgaccgttggcctctccagagactctgcagggtgggcagagcgtaggtggtttccacgtgaagctcccaaaggcgggtgcacttcttggggcatccccatggtgtatggggggcctgggtcaggctgtcttctctcctgttccagtagaaggacctgtggtcagagctagggtcaggtggcctggccgctccagggtggctcctggaggaagtgggga

SEQ ID NO: 83337 - DNA, 1911 bp, Homo sapiens
gctgaaagtgcaggaaatttaaaggcttggaccctgcgagacagacaaaccggtgccaacgtgcgcggacgccgccgccgccgccgccgctggagtccgccgggcagagccggccgcggagcccggagcaggcggagggaagtgcccctagaaccagctcagccagcggcgcttgcacagagcggccggacgaagagcagcgagaggaggaggggagagcggctcgtccacgcgccctgcgccgccgccggcccgggaaggcagcgaggagccggcgcctcccgcgccccgcggtcgccctggagtaatttcggatgcccagccgcggccgccttccccagtagacccgggagaggagttgcggccaacttgtgtgcctttcttccgccccggtgggagccggcgctgcgcgaagggctctcccggcggctcatgctgccggccctgcgcctgcccagcctcgggtgagccgcctccggagagacgggggagcgcggcggcgccgcgggctcggcgtgctctcctccggggacgcgggacgaagcagcagccccgggcgcgcgccagaggcatggagcgctgccccagcctaggggtcaccctctacgccctggtggtggtcctggggctgcgggcgacaccggccggcggccagcactatctccacatccgcccggcacccagcgacaacctgcccctggtggacctcatcgaacacccagaccctatctttgaccccaaggaaaaggatctgaacgagacgctgctgcgctcgctgctcgggggccactacgacccaggcttcatggccacctcgccccccgaggaccggcccggcgggggcgggggtgcagctgggggcgcggaggacctggcggagctggaccagctgctgcggcagcggccgtcgggggccatgccgagcgagatcaaagggctagagttctccgagggcttggcccagggcaagaagcagcgcctaagcaagaagctgcggaggaagttacagatgtggctgtggtcgcagacattctgccccgtgctgtacgcgtggaacgacctgggcagccgcttttggccgcgctacgtgaaggtgggcagctgcttcagtaagcgctcgtgctccgtgcccgagggcatggtgtgcaagccgtccaagtccgtgcacctcacggtgctgcggtggcgctgtcagcggcgcgggggccagcgctgcggctggattcccatccagtaccccatcatttccgagtgcaagtgctcgtgctagaactcgggggccccctgcccgcacccggacacttgatcgatccccaccgacgccccctgcaccgcctccaaccagttccaccaccctctagcgagggttttcaatgaacttttttttttttttttttttttttctgggctacagagacctagctttctggttcctgtaatgcactgtttaactgtgtaggaatgtatatgtgtgtgtatatacggtcccagttttaatttacttattaaaaggtcagtattatacgttaaaagttaccggcttctactgtatttttaaaaaaaagtaagcaaaagaaaaaaaaaagaacagagaaaagagagacttattctggttgttgctaataatgttaacctgctatttatattccagtgcccttcgcatggcgaagcaggggggaaaagttatttttttcttgaagtacaaagagacgggggaacttttgtagaggactttttaaaagctattttccattcttcggaaagtgttttggttttccttggacctcgaagaagctatagagttcaatgttattttacagttattgtaaatatagagaacaaatggaatgactaatcattgtaaattaagagtatctgctatttattctttataatatcccgtgtagtaaa

SEQ ID NO: 83338 - DNA, 421 bp, Homo sapiens
cctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataag

SEQ ID NO: 83339 - DNA, 695 bp, Homo sapiens
atcctgataaataacttggcagtggtaataccgtgattacgtttccagagaggtttctcctcagcagttgtcttagttcattttttgttgctgtaatagaatacctgaggctggataatttaccaggaaaaatacagttctgcaggctgggaagttcaaggccatggccctggcttctggcaatggctttcatgcttcatcataacatggtggagaaagtcaaaggggatgcagacatttgcaaatagagtcaaaacccaaagggcaccctgactctataacaactcacttagaagggtactcatccattctcctgagaacaaattccgtttttccagagtgaaaactcactactgaaagaacagcaccaagcaattcctaaaggattcatccccatgattcaaacacattcaactaggtccaagtttccaacacctgcacactggggactaaatttcaacatgagctttggtagggacaaacaaaccatatccaaatcatagcagtagtcttggaaaaacatatagaaagtaggggcagaactgagggcagaagagccaagaaagagcttatagtagtcaaaggtctaagtacttaagtccaaagaaaacttcaacatgaatgaatatgttgctgaacctcactttaaaataagtcaggaaataactgaatggttgacttttaaaaattacctg

SEQ ID NO: 83340 - DNA, 257 bp, Homo sapiens
  misc_feature (50)..(50): n is a, c, g, or t
agaggatcccctacggcaggttgtctccaccggagttgtactcccggcangttgtactcaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaacctgccggtgg

SEQ ID NO: 83341 - DNA, 2584 bp, Homo sapiens
cttgagccctctcatcaccagttatccatgctgctgcatataaacccagcttatttatttaaactgctgcatggattcccgccgtggataatgcctaccgatgggaatttaggtgacaaaaattttcagatggggaaaccagggcacagagagggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccccgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctgcccctgcccaccccgggcggctgaaactcactgagcagccaagactgttgcccgaggcctcactgtatggtgccctctccaaagggtcgggagggtagctctccaggccagagcttgtgtccttcaacagagaggccagcggcaactggtccgttactggccaagggctctgtagaatcacggtgctggtacaggatgcaggaataaattgtatcttcacctggttcctaccctcgtccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactgaaaaaaa

SEQ ID NO: 83342 - DNA, 829 bp, Homo sapiens
tagctggtctctgagtggactgaaaccaggtcagaatgacctgaaagcccagtatgttggggccgagtgagtggagactcatcacgtccagcctcctggaggctgcctgggagccctcctcttcctcgccccaccaggagacattctgcagaccagtgggccactcacttcctctgtcatcagctgtgcattaagacgcccagagatcatccttctcctggctttccctgggcaattccctctgggaggaaggagcacagagccagcctgcctagcttcctcggtggcctgtcagggtgcatctgtgtcaggtgcttggacggaggctggcatcctcataatgagagctctctgagcattggctttattattaggggcaagccgctcttccccatgttgaagggtgaggaccccagctctgaatggtgggacctgggatactgcggtctggcctgggtccctctgtggggtccagagacctgctgggaagcccaaaagcgtccaggactgtggggtctgtagctgcagccagtcatctcaccacagcttctcagccctggagcacctccaccagctcacctacctcccttaacttgggcatcacttctctggacacccctggtgctggaatggggacatcactgaccatgcctgtgttctctccttatgaaccccctaccctccccaggcctgtcttcgctcctgcttccaagaccacatgatccgtaactgcaactgtggccactacctgtacccactgccccgtggggagaaatactgcaacaaccgggacttcccagactggggtgagcgggggcacgggggatcg

SEQ ID NO: 83343 - DNA, 2598 bp, Homo sapiens
gtgcttccccgcccctgaacctgctccctcccagtcggtctcgccgcgctcgccgggtgtcccagtgtcaccaacactcggccgccgccgccagcttggcgcgcaccgccgcctccgccaccgccgacagcgcgcatcctccgtgtccccgctccgccgcccgagcaggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccccgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctgcccctgcccaccccgggcggctgaaactcactgagcagccaagactgttgcccgaggcctcactgtatggtgccctctccaaagggtcgggagggtagctctccaggccagagcttgtgtccttcaacagagaggccagcggcaactggtccgttactggccaagggctctgtagaatcacggtgctggtacaggatgcaggaataaattgtatcttcacctggttcctaccctcgtccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactgaaaaaaa

SEQ ID NO: 83344 - DNA, 2342 bp, Homo sapiens
cttgagccctctcatcaccagttatccatgctgctgcatataaacccagcttatttatttaaactgctgcatggattcccgccgtggataatgcctaccgatgggaatttaggtgacaaaaattttcagatggggaaaccagggcacagagagggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccccgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactgaaaaaaa

SEQ ID NO: 83345 - DNA, 788 bp, Homo sapiens
gaagggaattgtcaagctcaacatctacttcctgctcagggtgatattggtgctttggtcccgctcctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactgaaaaaaa

SEQ ID NO: 83346 - DNA, 299 bp, Homo sapiens
gctctccgttgcttcttgccattgctccagcatcatcttcttaaaacatggacaagaccaagccacctccatcttcagaacccattaaggactcttacccctacaacatgaggctaaactcatgccacagatgatctgtgccatattcttccagcttcctctcccaccaatgctcccacatcccatgttctggcttcccctgacaacttgccagcccccaagcatcacagctgccacttcccctctcccggctcagacagattcctcaggccagacactcctccctcctaatttccacc

SEQ ID NO: 83347 - DNA, 187 bp, Homo sapiens
cctcccaggttcaagcgattccctggcttaatttgtcttcttgctcccttctggcaccatgtgagctcttcacatggtgtgctttcatctgcttttttgaaattgcataatatttgagatgtatataaggcattcactttttatggttatttatttttgtctccctgttctactatagttttttttt

SEQ ID NO: 83348 - DNA, 533 bp, Homo sapiens
agtaagggtaaagatcagtgcttactagacaagcactcattaaatgttaattgttatttatacttgttacttaaagcaaagtgaaggtttttcaatattagaaagtttatcttctcatgactctagattttataagggttactatgtattgttacatctgtcaattgtgttaacaaactgtcgacattctcagtattcaaactgcaggagtaaaaaaatcggttttaatgaacaccttcctcaacctactgatgtttcaagagctgttagatacaaaataagcacttctaacttttcatttggaagcaagaaaaatactgtgcacaatgatatgagtaattgtaatttttaagattggcaaaaattttttgttttcattgaaagtttttcctgatgcttctcttcctttgaccttattttaagtctttatataattgtcggaggctgtttaacattaggcattttgacgcagtaaaggggttcattttaaattaatgttatagtaatatgtttaatactagtggtactgcttt

SEQ ID NO: 83349 - DNA, 409 bp, Homo sapiens
tcgttactggcatttctggcagggacggtggctgagagaagaatctggggaccaggctggagtgcagtggcatgatctcggcttactgcaaccactgtgttccaggttcaagctattctcccgcctcagcctcccaagtagctgggattacaggtgcccaccaccacgcctggctaatttttgtatttttagtagagacaaggttttgccatgttggccaggctggttcaaactcctgacctcaggtgatttgcctgcctcggcctccctaagtgctggtatcgcaggcgtgagccaccgcgccttgcctaggattcttacagttaaatgttgctgttttaatcttgaaatcttgagaactgaattggatgaatttgttctgattttcacttctgttttctttagcttt

SEQ ID NO: 83350 - DNA, 132 bp, Homo sapiens
gccagatagtaacaacgctagaagaaaatatgagtaatgcaaaacttggcactatgctacattaaacctttcttctcacttatggatcctgaaagcaccttgagattgaatgattgcaatagaatctgaaat

SEQ ID NO: 83351 - DNA, 806 bp, Homo sapiens
agaaccacaaacagggaacgcggacgggagtgggagggagcagaaggcacgtggtcctgtgtaaatccatcccgggacgcagtgcaaacaatggtctctgagcccacgtaaccacgcagagcgggacgttccgggatcagtggggagagtcagctccttcccgagccaagcagcagctgcgtgggggagggtcgcaattatttatttttgagacagggtctcgccctcttgcctaggctggagtgcagagttacgatcacagctcactgcagtctcgacctaccaggctcaagcgatcctctggcttcagcctcccgagtagttgggactataggtgcatactttcatgcccagctaatttttttttccccagttttttgtagagatggggtcttactatgttgcccaggctggtcttagacttctgggcttaagagatcctcttgccttggcttcccaaagtgctgggattacagacatgagttaccatgctcagctggggaggggtgcaatttttatttttatctttatttttttgagacggagtttcactccgtcacccacgctagagtatgatctcggctcactgcaacctccacctcccgggttcaagcgattctcgtgcctcagcctcctgagtagctgagattacaggcacccaccaccatgcctggctaatttttgtatttttagagacagggttttgctgtgtggcccaggctggtctcaaactcctgagctcaagcgacccccctgcctcggcctcccaaagtgctggggttacaggcgtgagccactgcgcccgg

SEQ ID NO: 83352 - DNA, 243 bp, Homo sapiens
tttctcagcaaacattaatgtaaaaaaggagagaatataagaaactaatatttttgcacactatagcaaggtctagtacacatctgtaaaaaggtattatccaagtaatagctttgagcaaggaaaaaaaaataacaaaccaaaatcaatctacctctagagctgaaaaatgctttaaaatggcccagtactctctaaaatgattaaatcaaccacaaaaccatctaaatgaaaaatgcagcc

SEQ ID NO: 83353 - DNA, 418 bp, Homo sapiens
gtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccc

SEQ ID NO: 83354 - DNA, 382 bp, Homo sapiens
gtgggcgcgcgggttgggggctctcgcgccgctccgggctctccccccccccggctgcggttgccgaagagaggccggagcgcggcgcccggctgctccacctggcgcgctgagcaccgcgcggggagcccccgggggcgggcggtggggggcgcggactgcgggaagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccg

SEQ ID NO: 83355 - DNA, 330 bp, Homo sapiens
caagttttctcacatttatggaaaaactgagcatcctccctcattttctgaatttcttactctagaaattctgcagacacttattgatcacctgccacatgccagacattccacttggctttaactaaaacgtgactgaaaattaaaaataattgtgtgttgtgattattcaaatgtccatccgatcagcctcacccagtgtggaagatgcgatggaaaccactgtctgtagatggggcagtgagggaaggctgggaacaaggggatgaaattttctgtagcatctgctgttaacagcaaaacatataatattaaaatgtgcataacttg

SEQ ID NO: 83356 - DNA, 731 bp, Homo sapiens
tttttgatccttttagctcagcaagctggtgtttgatgacctgagggactttgaccacagttagcttgtttgcccttgattttttttctattttgttatttttccttttcttctctccatattttttcttattcttttaaaatttgtttctttattttttagttgtattttcttatctttttctttgttctttcttcctttttctcatatgatggcctttccatgggtgtgtggagcctgagagtcattctctacctgatgaccactggtccctgccttttgtgggagaggactttgaggagccgcaggatcctctctcccttcactttacatacagtatgaagatcctgagctccgtagagccctatgagatggtgcaggagatgagccaggtgactcaagcagctgcacatgggagcgacgcaaccagcacaatttgctgtgtgtacagggcatgccctgctgagagggattttgtagagaaggaatacaggtgtgcaaattgttgtggcagagttgtcttcatggggtccaatttatgagggtatctggcacctccatgtccttcaaaaatcatgtgtccaaagtaaatgctgagcttaaattctaaaggacaccagaggccacctgggagacaggaaaggaagtccacctggtcctagctgcaggctggccctctgccccgacctggggagcttgagactggactatttctcgaggcacctctccaa

SEQ ID NO: 83357 - DNA, 277 bp, Homo sapiens
tataaccaagagtgttttaaagaaataaattatgtttgcctagcatcacccaactccatcagccaagaccaggcacttaatttgcaagttctagtgcaaaatagatatgtgcaactacttgttcattatttattattcatttcaaagtgatggtatcagagcattagcagaaccacagggccctgtaagactgcacaggtttttaatccatgaagttgtccttgccaatagaatactcatgtgacttctactagtgaatgaccaaaacatggtttag

SEQ ID NO: 83358 - DNA, 823 bp, Homo sapiens
tcctgctgagacaagaaaatattttcacaactcaagacaagttaaatatccacttatgggaacagtgctgaaggcctggactaggatggtagcaatggagacagactaaaggtcagcataacagtcaacattaagggggttgaatcaacagcacatagtacctgattggaaatacagagtaaattacagtgagaaaaagagatgcaatcattcccttgcatatggtccgtatgaagacgggatcattacaggaaaggtgaaggagatacagtcattatgctctatatacacccatttttatggctagcggctgaagatgggatgctttctttgctggaagacctattacctgttaggttgcaaaagatgtgatcatcttcctaaacaataatttagagtcccataacaattttaagtgtgctgttcatgaaaatttgaatacattgtattgggaatataatggaagtgagatgcctcatgtcgtgagaaaatctgacataaactccttaagcatgagaggccatgtgggtatggaagccctgaaagggaggaaaaaacagccagaccctagctgttccagtcatcccaactgaggtgccagacttgtgattgaggccatcttgcatcatctaggcctagtagagctgccaactgactgcagacacatgagtcaatccagctaatgccacatggagcagagacaagccgcccagctgagcccagtccagatgacagaatcatgagcaaataaggttgttgttcttttaagccactaaattttcgggtgatttgttacacagtaataaataactgaaacaactaa

SEQ ID NO: 83359 - DNA, 251 bp, Homo sapiens
agagtctcacttgttaacccaggctggagtgcagtggcgcaatcttggctcactgcaacctccacctcccagattcaagcaattttgtattttcagtagagatggagtttcaccgtgttgcccaggctggtgtcaaactcctgacctcaagtgatccacccgcctcagcctcccaaagtgctggggttacatgcgtgagccagtgcagatatgttttggtccccagcaggatatgttttggtccaatttat

SEQ ID NO: 83360 - DNA, 455 bp, Homo sapiens
aggacatggaatctgagaaggggttcatgcaaatttaggatgtcagtagaaaggctagaatactcggacgcaaactggagggcatgcaatacacatgaagctcagcccaggaaaaccacatgcataatcaggaaggggatggaagttctttcttggtaatttccatcacatcaaagcatcacccttctgatctactggaaaaccccagacttgctaggatctttctacttcatcagaaaaatgaggcaaatgccctagaaaaaagaaaaagtactgattctctgctctaaacccaagaattccaatgtaggtctatcagtctgggtagggtcaaggataaacataaatatgtaaccctaatactagggactggtgatggaaaaaatgtccccattggaggatgaagaaaaacacatccaaaccactatctcagtccccagtctttcctatgcctc

SEQ ID NO: 83361 - DNA, 391 bp, Homo sapiens
gagtaggctgagattcctatcattttgagtagctacacatttcaggttatgcaatcctgagctcagggtgccgcctgcaagcggtccacacccaaaccaccctgactttactcttaaagaggttaacaacccttgagtggtgctatttcagacggttgcgtatgctcagttaaactaatgtgaacacatgtgtttatgtctcgctaaggtgctagaatcattaataacaatcagcatattgcccctgctgggaaaattatgagtgtgagatcctaataaacactcactactgtgtaagggaaggaggtggaagagtggaaattctaagggcaaccctctccatgttacctagaagaaggattttttttttttttttcggaggtaagagaca

SEQ ID NO: 83362 - DNA, 306 bp, Homo sapiens
ctcccacccatatctaatccaacaagtccagctgcctctctctttacaatacccaggatcaggccccttctcagcacccccacagctgctgccccaaaggaagccacgtcatctctcacggagattgtgcagcagccactgcctcctttcaccttcgcctgtggtcattctccccacatggccagggaatgcgtcctgttaaagcctgctaggtcacggtcctcctctactcaaaatgctcccctggctcccactgcccccagagtaaaagcccagaccctacaaatgacacaaagccctacacga

SEQ ID NO: 83363 - DNA, 283 bp, Homo sapiens
agcaaggcaccatgcaggagatggaggagggaccgcaagagcctgtgccccagcctgcctggagctcagagccccagaaaagggacacgcaagggtttgccagggctgatgggagcactgctggctgtgcaggccatcatttcatcactctggccctcagttacctcatctgtaaaaaggggaataaatggtacctccctgctagggtcgtgctgaggctcacagtggctggcatagcatctctagtaaatacacaggaaccattgtcgtcactatggctatc

SEQ ID NO: 83364 - DNA, 794 bp, Homo sapiens
tagaaccattcatctgctgtgtgacctgtgccccttcttacgggcatgtgaggaggaggattgaggacggacaaagagcttgtttcacctgtgatcagtctttgacccttctgtgtgacgcaattccttatggagtttaccaggagcaaaactcacaattcaacagatggtttccacaatatcttaagaggtgtggtgcaaaactggaaactgttcaggatgattacaccctgcttctgatatgagaaaattaaacttgtattcaaaatggatgccaaggcaacataaaattataacaattcactacaagcatagatccagcttgagaatatcattcttttcacattggaaacccacggaggataaaaggatggatcattttgataaaggatgatatactccaggaagaaatgaagatccagtttgcagatgaaaataaagacaatgaataatccttcttggatttcatggattaagaagacacatatttaaaagtctggagaaagacttctcatgaaaagataaagtgaccccttttgcacctcaagtggcattatcagttcacttctcctgagacctggctgttgagatgatttcctgtgttttctcacatcctcacctgtcccttcaataaacgctcatcaccaaaagttttgcagatactgctgtctagatggatctttgctcactggaaatatcagtataaggacaacaatccatccatctgtgactgctaatggcaaagtcaatcatcatttgttgtttgcacttagcttgagaactctgctcaacct

SEQ ID NO: 83365 - DNA, 371 bp, Homo sapiens
cctgcaaatgttagccaaaatatgacaacatgttgttatttactctgttttcagaactactttttttctggctaaataattttttaaaattggaagagaaatggatagtaaatgaatgatgacttggagggcaagttcatggagctctttcttagttaatagattcctagtctttctgcattacttaattgcgtattaaaagtggaacccttgatgtaccatgtacagcatatatttattctgtagaaaattattaatttttaatggactaagtggctgtttggacaagggaccctgactattaatcaggaggtgagtgattgactgactttcatgttcattaattattcaaggaagttcacctacaaggg

SEQ ID NO: 83366 - DNA, 724 bp, Homo sapiens
gaggaaccacacctgaatttgggttctttgaatgattctttatttggtagtgacaatattaaaatagaatcattgattacaaagaagactgtggatcacacagttgaagaacaacaaacagaaaaagttaaattgatcacagaaaatctcagtaagctccctaatgcagactctgaatgcctttcttttgttggctgttcaacatcaggaacaaattctggaaatggaacaaatggtttattagaaggatcaccaccatccccattctttaagtttcaaggagaaatgattgtaaatgacttgtatgttccatcatcaccaatcctagcacctgtgagaagtcgtagcaagttggtttcaagaccatctcgatcttttctgctaagacatcgacctgtaccagagattccagggtcaacaaaaggagtttctgggagctatttccgtgaaagaagaaatgttgctacctcaactgaaaaatctgtggcatggcaaaattcaaatgaggagaattcatcttccatctttccttatggagagacctttctcttccagagactagaaaattccaagaagcgatctataaagaatgaatttttgacccagggagaagcactcaaaggggaagcagctactgcaacaaactcttttatcatcaaatcaagcatatacgataacagaaaggagaaaataagcgaggacaaggtggaagatatttggatac

SEQ ID NO: 83367 - DNA, 350 bp, Homo sapiens
gctcagagaggttgaaggctctgttcgggatcacacagtgagtcatgttctatctgctaagtgagtacaaaccctacaggtttcaacttccagaatgcaaccttcacaggatccagcctcacaagtagtaaaaatacaagcttgcttcggcaagactgacacatacattcctacaaagcttagaagctgctgtagatagccaagtttgtcctcctgctctggttggtggaatctgactacagtacactctcataaacatcccgaggccaggcagcatcccaagaaacatctggagaaaacagactttaccttgataacatctaccccctgggagctgctctgccctgatg

SEQ ID NO: 83368 - DNA, 211 bp, Homo sapiens
acttctctattatgtaagctagtgaattcccctttttgcttaaactagctgttaatacgtttctgccatactgaaatgacaatacactaactgcagcccaaactataaaaaccaaggtctgcaacagtgggaaactgagtttggttgagtgtgcctgggtctgggtctgtgctatgttcagtctcttttttttttttttttttttgaaacg

SEQ ID NO: 83369 - DNA, 488 bp, Homo sapiens
tgaaagtttcagggcagattctagttttaatgtagtgtgcttagaccctccagtgcacggcagcttatgtatatatgctataaacctttataaaataccgttcaaaagtttcatagtatttattttttcttttttataaaagatggggtcttactatgttgcccaggctagagtgtaatggctattcagaggcacaatcatgactccacagcctggaaattctggcctcaagcaatcctcccatgtcagcctaccaagtagctaggactataggtgtagtaccaccacctctggttttattttgcaaaaactgaatattaagcttttaactttttgtttcagtcaatatctgctgtctccaagaaacgctgaaacaaaaaattaaaagcttaatatttaggagctgggcatgcctgtagttccagctactcatgagtcttaagtgggagaatcacttgaggcctagcattggaggcagcagtgctcta

SEQ ID NO: 83370 - DNA, 421 bp, Homo sapiens
gactgcctatttaaattggttaaggacgtgtaatatggatatgtcctcagtgctaagaagcttgattttctgaaagcttagctctgatacgccacctgtgttttaaactttcggtggctatggctagccctactggtccagaccttgtttttcaatcttgtctgacaggactccttgttcaaatcctttgagccagtgaaacaggagttacttctcctcggggatatatcctgttttcttattcttttgctcacactgtttccagatctgggacatttctatttctgcacgtcaaaatctacctcctcttctaggtgtggttgaaatcagccatcttcttacagttttcctcgatgttctgcttcctccgtgacttgaagtcgtcccttcccttctgaatcgttacaatgtttcttttctg

SEQ ID NO: 83371 - DNA, 401 bp, Homo sapiens
ccactttcttgagtgtttttatccagaatagatgttgatttctgttgcaggttctttcactatctatggagataatatattatttttctccataggtctgttcatatggggtattatatttagtggatttcctcatattgaaagatagtctaattttgaaccaattttgcaaaaattccacttggtcatgttatattattttcttaatgtggtattgatttttgttagtatttctcacattcataaaaaatgttagccaggcatggtggtgtgtacctataccccagctattcaggaggctgagccaggagaattgcttgagcctaggagcttgaggctacagtgggctatgattgtgccactgctctccagcctgggtatcagagcaagaccccgactct

SEQ ID NO: 83372 - DNA, 1180 bp, Homo sapiens
caagtgactcgttacagccaaaagggccaaaggggcaattctcctttaacaagcgagtgggcaacgggttctttaaatctagaaattttcctaagttccggtcctctaggggttgtgcctgacaatgtaaagaagttaaatggccttccaaaatggcggtattcaccatgttaaaaaagatggcctctcattttaattaaaaatccttagaaaagtttgagtatagaaggtgggtattacaatccaaattcaacaaaggcctgtttttgaaaagcatagtgtgcagcttagcatctcaagttacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatatttatgtatgtacagtttgctaaagccaagttttgtttgtattgatttctttgcatttattatagatattataaaatagtttgtctgtgcttttttttccctaaacaaataactctaagtttcattattaagcaggcactgatcagaatgcaacctaaatgatcatttttctgtgcaatgaatgaagctggaacattagtgtatattaaaggaaaaggatggcaagaggcagcatggatttagacatagaagaccccaggtgattcctttttttctcttccttccatagtcaatcaaatctcctgaattcttgtttccggaaacctttcatcctctattctcc

SEQ ID NO: 83373 - DNA, 427 bp, Homo sapiens
tttactacattcactagtttcctatagatcctagtttaagaatgtgaaggaatactggcttttcaagtcaaattttaacctttctttaagttgaatatttaagttgggcttcatcactacaaagaccaatctcatattgccattgttatttcttatgggccaagaattttaacactgttttactattctaaaagatgaaaaaaaatatattaagtgtctttgaaatatgtgatatggcatagtgcattttacatttattgtatgtaaatatacacatgtgtttctaccatgaaaagccatgagaattatgcccaccatagtatggactccagaatcccaacttaatgttttatcagtggctaatcacatagatataaatttattttacttcttcaacaaaagaaaagccagtttccttaattcatgg

SEQ ID NO: 83374 - DNA, 5710 bp, Homo sapiens
  misc_feature (3271)..(3271): n is a, c, g, or t
ccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctctttgttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagaagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttgncttatcaggggaccacagtgccctagagtcacagatccgacaactgggcaaagccctggatgatagccgctttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatatttatgtatgtacagtttgctaaagccaagttttgtttgtattgatttctttgcatttattatagatattataaaatagtttgtctgtgcttttttttccctaaacaaataactctaagtttcattattaagcaggcactgatcagaatgcaacctaaatgatcatttttctgtgcaatgaatgaagctggaacattagtgtatattaaaggaaaaggatggcaagaggcagcatggatttagacatagaagaccccaggtgattcctttttttctcttccttccatagtcaatcaaatctcctgaattcttgtttccggaaacctttcatcctctattctcc

SEQ ID NO: 83375 - DNA, 5651 bp, Homo sapiens
  misc_feature (3271)..(3271): n is a, c, g, or t
ccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctctttgttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagaagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttgncttatcaggggaccacagtgccctagagtcacagatccgacaactgggcaaagccctggatgatagccgctttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatatttatgtatgtacagtttgctaaagccaagttttgtttgtattgatttctttgcatttattatagatattataaaatagtttgtctgtgcttttttttccctaaacaaataactctaagtttcattattaagcaggcactgatcagaatgcaacctaaatgatcatttttctgtgcaatgaatgaagctggaacattagtgtatattaaaggaaaaggatggcaagaggcagcatggatttagacatagaagaccccaggtgattcctttttttctcttccttccatagtcaatcaaatctcctgaattcttgtttccggaaacctttcatcctctattctcc

SEQ ID NO: 83376 - DNA, 1445 bp, Homo sapiens
ggggcagtgtcaatcaggaactgaaagattaagtgtcaatagtcacaggagcctcgtgtcttcgttgaatactggcactcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatatttatgtatgtacagtttgctaaagccaagttttgtttgtattgatttctttgcatttattatagatattataaaatagtttgtctgtgcttttttttccctaaacaaataactctaagtttcattattaagcaggcactgatcagaatgcaacctaaatgatcatttttctgtgcaatgaatgaagctggaacattagtgtatattaaaggaaaaggatggcaagaggcagcatggatttagacatagaagaccccaggtgattcctttttttctcttccttccatagtcaatcaaatctcctgaattcttgtttccggaaacctttcatcctctattctcc

SEQ ID NO: 83377 - DNA, 1310 bp, Homo sapiens
gtaagaggaaagatccgtttttctcatattttccacacaaaaagaggctgaggggcgtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatatttatgtatgtacagtttgctaaagccaagttttgtttgtattgatttctttgcatttattatagatattataaaatagtttgtctgtgcttttttttccctaaacaaataactctaagtttcattattaagcaggcactgatcagaatgcaacctaaatgatcatttttctgtgcaatgaatgaagctggaacattagtgtatattaaaggaaaaggatggcaagaggcagcatggatttagacatagaagaccccaggtgattcctttttttctcttccttccatagtcaatcaaatctcctgaattcttgtttccggaaacctttcatcctctattctcc

SEQ ID NO: 83378 - DNA, 5257 bp, Homo sapiens
  misc_feature (3271)..(3271): n is a, c, g, or t
ccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctctttgttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagaagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttgncttatcaggggaccacagtgccctagagtcacagatccgacaactgggcaaagccctggatgatagccgctttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatattatgattggcacgctgttaagccaagttgttggatgagtctctgcattatatagaatataacataataaaataaaaaaaacctgagggggcccgacccattgcgtatggagcggttcaataactgccgcttacaacccgactggaaacctgggtaccaactaacgctgtacataccctttccaggtggaaacaaaagccgaccatgccttc

SEQ ID NO: 83379 - DNA, 4489 bp, Homo sapiens
  misc_feature (3271)..(3271): n is a, c, g, or t
  misc_feature (4451)..(4451): n is a, c, g, or t
ccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctctttgttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagaagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttgncttatcaggggaccacagtgccctagagtcacagatccgacaactgggcaaagccctggatgatagccgctttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgcagacagcgccacgaggctctttctctgcaagatggttgcagagccattctggnacgaggtggcggccttggggaggcggtggatgactgcc

SEQ ID NO: 83380 - DNA, 4041 bp, Homo sapiens
  misc_feature (3271)..(3271): n is a, c, g, or t
ccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctctttgttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagaagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttgncttatcaggggaccacagtgccctagagtcacagatccgacaactgggcaaagccctggatgatagccgctttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggtagctgccccttgcctttcccacggcggacaaacagagagccaccgcgtgaacgaccgtgcagatggcacctctagttcgagctgctcttacacagcagcagaaaagggatctaacaaaaatgagtgagaatgctctcctcacctccagccatcccaaattcctgtattccacaaagatggttttcttttttttcttttctttctttctttctttctttctctctcattccttccttccttcttttttttctttctttctccttctttccttccttcct

SEQ ID NO: 83381 - DNA, 1834 bp, Homo sapiens
  misc_feature (1798)..(1798): n is a, c, g, or t
  misc_feature (1818)..(1818): n is a, c, g, or t
ccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctctttgttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggatttcaagaggaactggttatgctcaagagacanattccagtttttcctctagnttttctggtcctcctg

SEQ ID NO: 83382 - DNA, 551 bp, Homo sapiens
aaggactactccaaacagtgtgcttcgacagttcagcagcaggaggatcgaaccaatgagctgttgaaggcagccacaaacaaggacattgccgatgatgaggttgccacatggattcaagattgcaacgtatgttcaggagctaccttgttttccccacatgcccttcttagactgcccaagtttagcttttggtctgtgtaagctttggtatgtctttctatgtgagacagttacccaaaaataactgtcttaggatcaaagagcctgcctgattttcagaacacaggtgcacatgcatcagactaagaggtctcctcccattgttttattttttaaaatgagttgttttcccatttttcctagtggaatttagtcaatgtgaaagattgaggctctttgtgttttctagggtggtcaatataagacatgaccatatggggaatagtgttctatctttaaaaaatcttctgttccagatgttgtccatttacattcattaactcctatgtaagcatctacacaatagtttcatctaagatattaatggt

SEQ ID NO: 83383 - DNA, 388 bp, Homo sapiens
catgggtactgatcatttcatttgatttatttttcctttgctgcacttttagtttaattttcattagtagcttgtctttatttgcctggactgaacattcttctttctttaccccctgttcattgcaaacagccacgaggcaagtgtagtctctcacagcctggaccctctgtcagcagtccacatagcaggtacctccttctcctggtttccacactgttctagaaccccaagaggatgatgaaaattgtccatgacttaggttgacctatatctggtctgcctcagggtagttgggaaattactcatttcagtccacaccctttcctcatacattggaagagaagtttctgaatgaaatgttcaagtaaatttcagagcataaaat

SEQ ID NO: 83384 - DNA, 570 bp, Homo sapiens
ccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctctttgttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaggcgtaatcggtaccgagctcgattcta

SEQ ID NO: 83385 - DNA, 3560 bp, Homo sapiens
  misc_feature (1121)..(1121): n is a, c, g, or t
accgtgtccataccccttcgtgggatacgactaataactcagtcgggacctggagtctgcaatgtacagtgctctgccctctgaggatgaagaaggtcaggatgacaaagatttctacctccggggagctgttggcttatcaggggaccacagtgccctagagtcacagattcgacaactgggcaaagccctggatgatagccgctttcagagacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttgncttatcaggggaccacagtgccctagagtcacagatccgacaactgggcaaagccctggatgatagccgctttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatatttatgtatgtacagtttgctaaagccaagttttgtttgtattgatttctttgcatttattatagatattataaaatagtttgtctgtgcttttttttccctaaacaaataactctaagtttcattattaagcaggcactgatcagaatgcaacctaaatgatcatttttctgtgcaatgaatgaagctggaacattagtgtatattaaaggaaaaggatggcaagaggcagcatggatttagacatagaagaccccaggtgattcctttttttctcttccttccatagtcaatcaaatctcctgaattcttgtttccggaaacctttcatcctctattctcc

SEQ ID NO: 83386 - DNA, 2098 bp, Homo sapiens
tggaactgcatttttacttcactttgacctctggcatcaagctgtgaatgacgaatcaccccttttttttttcaaatcttgactagatatcagaggatacctagacatacttctgcttcgctatatttaatgttgtgcttttctgtttaaaagattatcttacatctcacttgcatactaatctatattttaattactgtcatatatacattaactaatttgaaccttccaataatactgtggaccaggcatcaaatcaaactgagatcagagacggtcaggggtcttatagaatatttttggcagaggcaggattagaactcaggccgtgagctgctgcatcctttagtgtgtgagctccacgtttgatgctcaggtataatttcccaccaagttaagttgattgcattctgcacttttggagcttttgccaattatcaaaaatgcttagaaaaattaatttgtttttgtatgcatagcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatatttatgtatgtacagtttgctaaagccaagttttgtttgtattgatttctttgcatttattatagatattataaaatagtttgtctgtgcttttttttccctaaacaaataactctaagtttcattattaagcaggcactgatcagaatgcaacctaaatgatcatttttctgtgcaatgaatgaagctggaacattagtgtatattaaaggaaaaggatggcaagaggcagcatggatttagacatagaagaccccaggtgattcctttttttctcttccttccatagtcaatcaaatctcctgaattcttgtttccggaaacctttcatcctctattctcc

SEQ ID NO: 83387 - DNA, 3706 bp, Homo sapiens
ccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctctttgttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagaagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgataggacggtactgccaggaggtcttcgggcgtgtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatatttatgtatgtacagtttgctaaagccaagttttgtttgtattgatttctttgcatttattatagatattataaaatagtttgtctgtgcttttttttccctaaacaaataactctaagtttcattattaagcaggcactgatcagaatgcaacctaaatgatcatttttctgtgcaatgaatgaagctggaacattagtgtatattaaaggaaaaggatggcaagaggcagcatggatttagacatagaagaccccaggtgattcctttttttctcttccttccatagtcaatcaaatctcctgaattcttgtttccggaaacctttcatcctctattctcc

SEQ ID NO: 83388 - DNA, 5176 bp, Homo sapiens
  misc_feature (3271)..(3271): n is a, c, g, or t
ccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctctttgttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagaagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttgncttatcaggggaccacagtgccctagagtcacagatccgacaactgggcaaagccctggatgatagccgctttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaactccaccatgcacgagcaagtgtaatacggcgcccagtcaccaacgattgtat

SEQ ID NO: 83389 - DNA, 3532 bp, Homo sapiens
  misc_feature (3271)..(3271): n is a, c, g, or t
ccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctctttgttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagaagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttgncttatcaggtaggaaagagcctctccagtttgccagcttaaaggaaagtcagagggaattaatattgccctggaaacatgacagctatccagaatcatttgcttccttctttcatgcggggaaattgtacctaagtgaacacttagatatgaatgtgattataaaatgcaaaatttggtgtggccgttgatttattccacgtagatttgtggtagtaggtgacaagcgctttgccaggttctagggatacacagttcctct

SEQ ID NO: 83390 - DNA, 2626 bp, Homo sapiens
cgcttccgcctccagcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttgaaaaaaaaaaaaaaaaaaaaaaactctcagagggccctcatatgccggggccgccggaaaaacagaggtgtcctgaacttgggcccttgcgccatacgctggtcccctggcccaagtttccgtggtccccggcgggaacaactttcgcgggtcccccttatacgggcgccgattaaattcagtaaccccgtgtacccggttatgg

SEQ ID NO: 83391 - DNA, 2422 bp, Homo sapiens
cgcttccgcctccagcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83392 - DNA, 4611 bp, Homo sapiens
tgtcgccgggagggcagcggccaggcaggctgggcaggggggtggggtctggctctgtcccacaggacggtgtgacccctgggtgggctcttgacgggctttcctcactggagttcctcaggccgctctcctgaagcggtgctcagaggccctgaccatcctgccaggcgcccgtgacccctgacctcttccctctgcctcctgctgtggcttctgtccacaagcccctccccttcccctttggacccctcaggcctccccagctgcctgcgctggaccctggcggggctgtttcactttttcctgggcagtgtcatgtatgcacctgtgggctgactgtgtggccacatccagtcaggacccagcctccagaactgacccagggaggctcccgctggccccaggaaggagaagtagaaactgatgatcaggcggggcgagagaaccacaccagcggccctgttgagaaatcaggccgagaggtcggtggcggtggctcaggcctgtaatcccagcactttcggaggcctgggcagtcggatcaccagaggtcaggagtccaagattagcctggccaacatggtgaaactgttgtctctactaaaaatacaacattagccaggcgtgatgggcacctgtaatcccagttcctccagagattgaagcaggagaatcgcttaaacctgggaggtggaggttgcagtgagtggagattgcctgggaggtggaggttgcagtgagtggagattgcctgggaggtggagattgcatgaagctccatctcgaggggaaaaaaataagaaagaaaaatcaggcagagaggcaacgccaggtcccagctggagctcagcggggagccaggggatacagtggctgaccgggcctcctaaccccccttctagcactcccccaggatcctgggtcccaattgttgccctggacaaatacgcccattcctgccctacccaccgagtgaggctcagccccaggccccccaccctcatcacaaggtcagggctgtgtcccagcatcctcatcactaggtacttccggccctttgctcagccccatgatgcttggcctgcagagatgggggctgaagggcttggggcatcaaggggacctgacatcttgctgagaagccatcactagacagggctggaggctggagactcagggcctgccctcaccgtggccagtgaggcgtggggttgggcagggaaggggcattcattcattagaccctgccagaagcacctgggtccccttctggggctacaggtggtgaggccactgcccccaagaacacagcctggtgactttagtgtacaaagcagggggagtctccaggggcacagaacagaggctaaagccagggtggaggtggccagcaggcctaggaggaggagagggtcagggccacaccccaggggaggtgcatgtcagccaggggccaccctaaggtggaagccaggagtcccaaaggggcctagagaaggagcagccccccacctggctaccgcagccctctctggttctgtgcagggtattgggatgcgttactgaggcccaaatctgccccactgggaacccccaaaaaagagccagggcaggagaatgagagggaggagccatgaaacccccgccctttaaagacagctctgtggcagctggcccaggccctgcagccctcaccacgttgggactcacttgggggtctcccatgggggtcctaatcccatctcttttcttcccagtccagaatgacagggtccagaaactggcgagccacgagggacatgtgtaggtatcggcacaactatccggtacgtacctgcccctgccccgggacacagaaccctcccgccagctgctcttctcaggcagaatgtcccaggttctactggaaggctggcctggcttgctgtgccagggccacagttctgggcaggaccctgcctggggcacagcctggtatagattcagagccctgcccttcccctctcgcgggagaccgggggcatccccctacttttctgagcttcagcacaccgtcgccttgcaaacatggccatagtgccagcctcgtgatgcacacgtgtggggtccgtgataccgcccacacagcaccccacccccatgccagccctgtctcctgcaggttgtcctcagccattaccctccacacccctgaatcacggaaacccctgtgctgccttcagggtgctgaggaggggacctgccaggcctggcctggctggcgaaatggggaaggggggtccctggggcttggaggcagctgctgtcctctgaatggcccccacctgcagagtgaggagccaggcgggctcttggggtattgggccagcctggaggtttgcagatgcgcctccccgaaagacacggagggccccagggcagcttgtgtctgatggatccctgctgtcccctttctctggctcttcaggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83393 - DNA, 1215 bp, Homo sapiens
tagaattcagcggccgctgaattctagcccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggacctgcaggggacgagccagccgagagcccatcggagaccccaggccccagcccggcaggacctacaagggatgagccagccaaggcgggggaggcaaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83394 - DNA, 2630 bp, Homo sapiens
cgcttccgcctccagcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttgaaaacaacacaaacccaacaaaaacacctcggagggcaccaaagtccgcgcgccgcaaaagcggctcaccgacaacggcccactgggccaaaagacgatcccgtgacccgaagttcctgggccccagggtgcacaactcggccggacaccccatataagagacccacacacaatccgaaacccccggtaacggataaaacaaggacaac

SEQ ID NO: 83395 - DNA, 2478 bp, Homo sapiens
ggggtcagaagatatttatgaggtgccgtgactcgggttaatttcatgacgggggctcgggttcgttgtactatgtggaccctcgagcttgaccaattcacaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83396 - DNA, 2456 bp, Homo sapiens
cgcggtttgtatttcagtgatggggagctggcgtttagttgaagattcctgtgttgctaggtctagtccattgttacaagccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83397 - DNA, 2194 bp, Homo sapiens
gtctggggtagatctagaggatcccgttggcgtgagggtcaaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83398 - DNA, 1463 bp, Homo sapiens
cgcttccgcctccagcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctgggctgcgcccctgtctttgtaaattgacccttctggagtggggggcggcgggcagggctgcttttcttagtctgataccaagcaaggccttttctgaataaattcatttgactttga

SEQ ID NO: 83399 - DNA, 955 bp, Homo sapiens
  misc_feature (922)..(922): n is a, c, g, or t
cgcttccgcctccagcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggcccctaacacgtgggagcatggnttggcctcataacgggatggtctagagtacctg

SEQ ID NO: 83400 - DNA, 2344 bp, Homo sapiens
tagaattcagcggccgctgaattctagcccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83401 - DNA, 2404 bp, Homo sapiens
tagaattcagcggccgctgaattctagcccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83402 - DNA, 1652 bp, Homo sapiens
tagaattcagcggccgctgaattctagcccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctgggctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83403 - DNA, 2443 bp, Homo sapiens
ggaggaagagtataggtcggtcctggtgttatttcgtgcgagggcccggatgtcgtcgtactatgtgccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83404 - DNA, 2456 bp, Homo sapiens
  misc_feature (56)..(56): n is a, c, g, or t
aacgaatatgtatgagtgcgtcgctcggtttaatttatgacgaggggcgcgttcantgataaatcccttgtgctagtccgccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83405 - DNA, 3970 bp, Homo sapiens
tgtcgccgggagggcagcggccaggcaggctgggcaggggggtggggtctggctctgtcccacaggacggtgtgacccctgggtgggctcttgacgggctttcctcactggagttcctcaggccgctctcctgaagcggtgctcagaggccctgaccatcctgccaggcgcccgtgacccctgacctcttccctctgcctcctgctgtggcttctgtccacaagcccctccccttcccctttggacccctcaggcctccccagctgcctgcgctggaccctggcggggctgtttcactttttcctgggcagtgtcatgtatgcacctgtgggctgactgtgtggccacatccagtcaggacccagcctccagaactgacccagggaggctcccgctggccccaggaaggagaagtagaaactgatgatcaggcggggcgagagaaccacaccagcggccctgttgagaaatcaggccgagaggtcggtggcggtggctcaggcctgtaatcccagcactttcggaggcctgggcagtcggatcaccagaggtcaggagtccaagattagcctggccaacatggtgaaactgttgtctctactaaaaatacaacattagccaggcgtgatgggcacctgtaatcccagttcctccagagattgaagcaggagaatcgcttaaacctgggaggtggaggttgcagtgagtggagattgcctgggaggtggaggttgcagtgagtggagattgcctgggaggtggagattgcatgaagctccatctcgaggggaaaaaaataagaaagaaaaatcaggcagagaggcaacgccaggtcccagctggagctcagcggggagccaggggatacagtggctgaccgggcctcctaaccccccttctagcactcccccaggatcctgggtcccaattgttgccctggacaaatacgcccattcctgccctacccaccgagtgaggctcagccccaggccccccaccctcatcacaaggtcagggctgtgtcccagcatcctcatcactaggtacttccggccctttgctcagccccatgatgcttggcctgcagagatgggggctgaagggcttggggcatcaaggggacctgacatcttgctgagaagccatcactagacagggctggaggctggagactcagggcctgccctcaccgtggccagtgaggcgtggggttgggcagggaaggggcattcattcattagaccctgccagaagcacctgggtccccttctggggctacaggtggtgaggccactgcccccaagaacacagcctggtgactttagtgtacaaagcagggggagtctccaggggcacagaacagaggctaaagccagggtggaggtggccagcaggcctaggaggaggagagggtcagggccacaccccaggggaggtgcatgtcagccaggggccaccctaaggtggaagccaggagtcccaaaggggcctagagaaggagcagccccccacctggctaccgcagccctctctggttctgtgcagggtattgggatgcgttactgaggcccaaatctgccccactgggaacccccaaaaaagagccagggcaggagaatgagagggaggagccatgaaacccccgccctttaaagacagctctgtggcagctggcccaggccctgcagccctcaccacgttgggactcacttgggggtctcccatgggggtcctaatcccatctcttttcttcccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83406 - DNA, 2547 bp, Homo sapiens
cgcttccgcctccagcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgagtgcagctcggcagggagcccgtgggctggctgctggtcccaatgcttcggttcgcagtctccatgatattgagcaggggttccatgacatgctgggcgacgcgcacgagggggacctatgtgttacgcgtattcagggcagcgaagcataatccggggaatcatgggtgggaccgtgaggatcgtgcaatgtggggtggacgacgtctaaaaagccatgagtttttctacgagaggaatgagatccagggttcccgtgccgcaaggggtgctgttgtcaattcgagggaccttttcgtatcagcagagctgggagcgggaccaaactattgaggctcctttgaggggactagttcactccttacattccagttggttgtttcctctgcgagacccgtggagtgcaactggtgttgccattgcccctcacggctcagggggggtcgagggtgttagaagatggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccaggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83407 - DNA, 1219 bp, Homo sapiens
cccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgccgcccgcccgcccgcccgcccgcccgcccgcccccgcccgcccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 83408 - DNA, 730 bp, Homo sapiens
aaaaatctattcagttcctgggtttagatagcagagtatggccacgagcgatacctgtgtagttttgtcaggtaaaaagacagttcgacagcagagggcatggtgatgacggcactcgtgccccagtctcagtgggaaggctggccctctctggctcatgccaggtgactggcatgcggcctcttttccccttcatcctggagcctcccttcccatctctcctgtactggatcttatgcgtattagaggacatcttcctgtccttcctgggaaaggagcgtgaggcctcatatgtctgaagatgtctttactagggcccagcacggtggcttacgcctgtaatcccagcactttgggatgctgaggtgggaggatcacttgagcccaggagttcaagatcagcctgggcaacatagtgagaccccatctctatttaagaaaaaaaaaagaccccgggcgtggtggctcatgcctgtaatcccagcactttgggaggctaaggcgggcggatcaccaggtcaggagctcgagaccatcctggctaacatggtgaaaccccgtctctactagaaatacaaaaaattagccgggtgtggtggtgggcacctgtagtaccagctacttgggaggctgaggcaggagaatggcatgaacccgggaggtggaggttgcagtgagccgagatcccaccactgtactccagcctgggcgacagagcaagactccgtct

SEQ ID NO: 83409 - DNA, 327 bp, Homo sapiens
atggcaatgtcacactatgaaaatgaatagcccctattgcttagcatacctaaaaagagaagtgttgacattgaattttccaaaatcatagacaataatgtatgtaggaatatattactgtgtatcttagagtctgtgaactttcaattgatttttgatggtttctggttatccttaactaaatggtaaaaataatttcatcggtattatacatgaatttattatcagttgaaattaaaaaattgctttctggaaaagtaatgactattttatatataaattgacaggaataagattatctcttgtcattttgaaaatttctttcaa

SEQ ID NO: 83410 - DNA, 1198 bp, Homo sapiens
gcggccgcagccgctgccccgggccgggcgcccgcggcggcaccatgagtccccgctcgtgcctgcgttcgctgcgcctcctcgtcttcgccgtcttctcagccgccgcgagcaactggctgtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaagggactcgggaggcggccttcgtgtacgccatctcttcggcaggtgtggcctttgcagtgacgcgggcgtgcagcagtggggagctggagaagtgcggctgtgacaggacagtgcatggggtcagcccacagggcttccagtggtcaggatgctctgacaacatcgcctacggtgtggccttctcacagtcgtttgtggatgtgcgggagagaagcaagggggcctcgtccagcagagccctcatgaacctccacaacaatgaggccggcaggaaggccatcctgacacacatgcgggtggaatgcaagtgccacggggtgtcaggctcctgtgaggtaaagacgtgctggcgagccgtgccgcccttccgccaggtgggtcacgcactgaaggagaagtttgatggtgccactgaggtggagccacgccgcgtgggctcctccagggcactggtgccacgcaacgcacagttcaagccgcacacagatgaggacctggtgtacttggagcctagccccgacttctgtgagcaggacatgcgcagcggcgtgctgggcacgaggggccgcacatgcaacaagacgtccaaggccatcgacggctgtgagctgctgtgctgtggccgcggcttccacacggcgcaggtggagctggctgaacgctgcagctgcaaattccactggtgctgcttcgtcaagtgccggcagtgccagcggctcgtggagttgcacacgtgccgatgaccgcctgcctagccctgcgccggcaaccacctagtggcccagggaaggccgataatttaaacagtctcccaccacctaccccaagagatactggttgt

SEQ ID NO: 83411 - DNA, 534 bp, Homo sapiens
gcggccgcagccgctgccccgggccgggcgcccgcggcggcaccatgagtccccgctcgtgcctgcgttcgctgcgcctcctcgtcttcgccgtcttctcagccgccgcgagcaactggctgtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaaggtggcaaagcctggcatggaggagacagtggatgtcatctactgacagaaagcaggtcaggggagaggactcaaaggcgcaaggaaggaggtagcctggggcaatgctggcctgaagccatcgtgggtactcaggaccccatgagaagccctccttacctttgggggaggaaccaag

SEQ ID NO: 83412 - DNA, 921 bp, Homo sapiens
gcacgtgtgcaactccacgagccgctggaactgctccacactcgactccttgcccgtcttcggcaaggtggtgacgcaagggactcgggaggcggccttcgtgtacgccatctcttcggcaggtgtggcctttgcagtgacgcgggcgtgcagcagtggggagctggagaagtgcggctgtgacaggacagtgcatggggtcagcccacagggcttccagtggtcaggatgctctgacaacatcgcctacggtgtggccttctcacagtcgtttgtggatgtgcgggagagaagcaagggggcctcgtccagcagagccctcatgaacctccacaacaatgaggccggcaggaaggccatcctgacacacatgcgggtggaatgcaagtgccacggggtgtcaggctcctgtgaggtaaagacgtgctggcgagccgtgccgcccttccgccaggtgggtcacgcactgaaggagaagtttgatggtgccactgaggtggagccacgccgcgtgggctcctccagggcactggtgccacgcaacgcacagttcaagccgcacacagatgaggacctggtgtacttggagcctagccccgacttctgtgagcaggacatgcgcagcggcgtgctgggcacgaggggccgcacatgcaacaagacgtccaaggccatcgacggctgtgagctgctgtgctgtggccgcggcttccacacggcgcaggtggagctggctgaacgctgcagctgcaaattccactggtgctgcttcgtcaagtgccggcagtgccagcggctcgtggagttgcacacgtgccgatgaccgcctgcctagccctgcgccggcaaccacctagtggcccagggaaggccgataatttaaacagtctcccaccacctaccccaagagatactggttgt

SEQ ID NO: 83413 - DNA, 386 bp, Homo sapiens
tcacacaaatgattccaaatttgatttcgctttcttatagatattcttgaaagaaaatgactaattactatctgatttgtatcttgttttccttcacgtacaaatagtagacatcttttcattctccaacattatatgcccaagctaaattctaactaaaatcttcagtctcccctcacccccgtaatttcaacttttattttagattcagggggtacacatgcagattcattacatcagtgtattttgtgatgcttgggttttgggatacagatgatcccatcacccaggtggtgagcatagtacccataggtattttttcagtctgtacctgcctccctccattcccctcgtagtccccagtgtctattgttcccacttctatg

SEQ ID NO: 83414 - DNA, 3163 bp, Homo sapiens
gtaatgcagagataataaaacttcttaggtccataggtcttataataatttaataacctaaacatggtatacaaattcctccaaacccaataacataattatagtttcaaaaagttccccaaactttcaagttagattttattgctttgatgagtggctttaaatatgaaaagtcttgcctgtgaagggcaatccttttcccgtggactgggatctatagaaatacagaaatgtgcccaggggttcatctccctaataaccatcattcacatttctcaacctccctaataaccagccaccatgtgagaaggatccacagttactgtttatgactataattaactagtacctgggactggtcagtggagttggttgcaacctgatgctaaggatgtcaaagttgtctcggcctctgttcccagccagtaagtaattccctggcctcgggccataccccctaatcttggtcagctgattatgacaggcagacagcacagtaaataacactatatattaagaaaacccaaagcatatgtatcaatggtatatacccaacagcatcctaggaatggagagtctgtagcaagggcctccaatgtgaaggtcaacacagtcactgtgatgcgtgtatttccattttgtaaagcatgatctctggtggtcatttttatcttcctaacttattggaaaagtctcctgttttgggggcccgcccctggtcacagccagactgactcagtttccctgggaggtcccgctcgagcccgtccttcccctccctctgcccgcccccagccctcgccccaccctcggcgcccgcacatctgcctgctcagctccagacggcgcccggacccccgggcgcgggatccagccaggtgggagccccgcagatgaggtctctgaaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtcttcattgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccaggtcgctgtccctccagccccagctcacgcagcgctccgggctgcagtaggaagtggacagagcgcccctcccgcgcctttccgcggagcccttggcccctcggacagcccatctgcctgttctgaggattcaggggctgggggtgctggatggacagtgggcatcagcagcagggttttgggttgaccccaatccaacccggggacccccaactcctccctgatccttttaccaagcactctcccttcctcggcccctttttcccatccagagctcccaccccttctctgcgtccctcccaaccccaggaagggcatgcagacattggaagagggtcttgcattgctatttttttttttagacggagtcttgctctgtcccccaggctggagtgcagtggcgcaatctcagctcactgcaacctccacctcccgggttcaagcgattctcctgcctcagcctcctgagtagctgggactataggcgcgcgccaccacgcccggctaatttttgtatttttagtagagacggggtttcaccgtgttggccaggctggtcttgaactcctgacctcaggtgattcaccagcctcagcctcccaaagtgctgggatcacaggcatgaaccaccacacctggccattttttttttttttttagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaaacgggggcacccccttttcttgccaaaatatatctctgcctttggttttattttcctttgggtccagaagttttcaatctctggagtttgtgcattgggcctcacccggagcagacgagggcagggctgggaaggatggggagggacatagaggattcggttcctcccccaccttgtttcttgagtgtttcctaatcacttgatgggtggtaccacctagaattcttccagcagcctgtaatgggagggctacaggttagccctggaacctgcaatcaaacc

SEQ ID NO: 83415 - DNA, 1340 bp, Homo sapiens
ccacccgtcccagctcggcttagcccccgcggacccctccaggccgcgaccccagggcgtcctgtgccgccacgccctccatctgtgtgggtcctctgctgggcccgcccctggtcacagccagactgactcagtttccctgggaggtcccgctcgagcccgtccttcccctcccctcgccccaccctcggcgcccgcacatctgcctgctcagctccagacggcgcccggacccccgggcgcgggatccagccaggtgggagccccgcagatgaggtctctgaaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctgctttgcccaccccatgctgtaactccccggacccagtttccgtctcccgactggactgtgagcctatgagggtgcgccctgggagttcctcagctgctgttgctgcttcattcagcctacaggacctactgctcaggaaatgatttgattgattgattgatttaatttatttagagatggagtct

SEQ ID NO: 83416 - DNA, 1882 bp, Homo sapiens
ccacccgtcccagctcggcttagcccccgcggacccctccaggccgcgaccccagggcgtcctgtgccgccacgccctccatctgtgtgggtcctctgctgggcccgcccctggtcacagccagactgactcagtttccctgggaggtcccgctcgagcccgtccttcccctcccctcgccccaccctcggcgcccgcacatctgcctgctcagctccagacggcgcccggacccccgggcgcgggatccagccaggtgggagccccgcagatgaggtctctgaaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtcttcattgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaaacgggggcacccccttttcttgccaaaatatatctctgcctttggttttattttcctttgggtccagaagttttcaatctctggagtttgtgcattgggcctcacccggagcagacgagggcagggctgggaaggatggggagggacatagaggattcggttcctcccccaccttgtttcttgagtgtttcctaatcacttgatgggtggtaccacctagaattcttccagcagcctgtaatgggagggctacaggttagccctggaacctgcaatcaaacc

SEQ ID NO: 83417 - DNA, 380 bp, Homo sapiens
tttccttttaagaacatgacctggaagttgaaaacatcttattccattagccagaatcaatcacataattaattttctacaaggcaggctgggaaatgtaatctttagggaggcagccatgtgcctagctaaggcttctgttactatagaggagagagaaatggatcctggggagacagctaggagcctctgctacaccggaatagtgacatttgcccttcagtgttcctgtactgctgtggctttcaggcaaattcaaacttgacacctttttttttctttttcttattaatacagtatttgtctttcctctatcaaaccctgagccaaccatgttccccaggccatctggggaggtgcaggaaaagaaacatacaggg

SEQ ID NO: 83418 - DNA, 2769 bp, Homo sapiens
ggccttgtgggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgtatcatgagt

SEQ ID NO: 83419 - DNA, 2067 bp, Homo sapiens
tttgcatgtattttcataagggatgttaatctgtggttttctcttcttgtgatgtctttgtctagctttggtatcaggatacagctagcctcatggaatgaactaggaagtatgccctcctcttctagtttttggatgacccatcatctcttacctcacctacagcaggaaccttgaaattggacttctgcctcacaccctgcaatctcatctccacattatgaccagagtgatcttcttttttaaaaaaaacttattgttactatttcaattgataaatgaattgtatatatttatggtgtacaacgtggtattttgattgtgtacacattgtggaatggctaaatcaagctaattaacacaccattttttgtggtgagaacacttaaaatctactctcagcagttttcagatacagactacattgttattgactgtagtcaccatgttgtacagagtgatcttctcagtggacaactctgtgcacatccctcagagccgcaaggcagtgatatccaggttcctgaacagggtctccaaagccctccacccacgggtcctttccttcctgtctcgccacatcttccaggtccatgtctcagctatgtgaggttcttttcagttccttaagcacatcccactgttagctcagagatatgttgcagtcctaactccaagtacctataaatgtggccttatttcacaatagggtctttgtaaatgtaattaagttaggatgtggtcatattgaattggggggtgggggttaagccaaatgactgtgtccttagaagaagaggagaagagacagacacagacaaaggaaagaaggtcaggtggaaatggaggcagagatcagaatgatgtgtgtataagccaagaacacctgggactatcggaacctggggcagccaaggaaggatcctcccctagagtgttcggaggaagcatggcactgccgataccttgaattcagacttccagcctccagaactaggagagaataaacttctgttgttttaagccactgagtttgtggttctttttccagcagccctaggaaactcatacaaggatataggaggtttatttgcagatgagtttgttgcttctttagtggtctgtatctcatagcactagaaagaatagaaaagttaattccagataatgtgatgtatttgttttgtttttcgtagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggcatggggggctgggacccagcgagcccgtggctctctcaggagtagatgagtgctagaccctggacctcctgactccgagttcatgtagtctccgctgcaccaactccaaaaccgtgggattctgcttttcatcctctgtggtgttggccagatcatacttgaaggccttggaaatggagtctgctgattagccaaaaagcccactttaggtagcaagctaacacttttttacatcaaagtagtaaagaagcagttaccaaacttctcag

SEQ ID NO: 83420 - DNA, 4357 bp, Homo sapiens
ggccttgtgggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 83421 - DNA, 4339 bp, Homo sapiens
tgaaataagtctttttccatttcattgatgtggttctaggttttgtcttctgtaaaaagagtttcctttggagatgcattaggagacaatctttagttttcattagttttaagtagcagtaattcatgaaacagtagcccagggttttcagagtttaattaatgttttgaatatgattaatttatcacccagggaaaatgttaactacctaggaaaaatgacagaatataacttcttatgaggccctttacttaaaacctcattaagtagcaaatcagaattttgttttaaaaaattgaaatttattagaagactatgcatctctctatattgaaagtcataattgatataatcctataaaatacaaaattcctggaaaactggaatcacaaatatatatttggaaaactcgtgttaagttttatggaagcacaagtctatggcagtagttgctactttggcctttttctttcagtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 83422 - DNA, 3971 bp, Homo sapiens
ccagaggagtctctcgaatcgacggtttctctgaatgagaatgtcatattccagaatgtgactttatataaaatgtacagcattctaatatactgaaaagatatttaatcagtatattagcttaactagtagtattactgaatgcaccagactgcattgactcacctggctattgaggcacttttctctttgattcccccaggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 83423 - DNA, 3989 bp, Homo sapiens
taccttagtaaatgcaattttcgaacaggcccccatcttcaactggtatagcatcttccacaccctgtagccttcaaacatcacctgttaaaatactgcccatgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttaaaaaaaaatgaaaagatcttat

SEQ ID NO: 83424 - DNA, 4152 bp, Homo sapiens
taccttagtaaatgcaattttcgaacaggcccccatcttcaactggtatagcatcttccacaccctgtagccttcaaacatcacctgttaaaatactgcccatgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgtatcatgagt

SEQ ID NO: 83425 - DNA, 2435 bp, Homo sapiens
ggccttgtgggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggcatggggggctgggacccagcgagcccgtggctctctcaggagtagatgagtgctagaccctggacctcctgactccgagttcatgtagtctccgctgcaccaactccaaaaccgtgggattctgcttttcatcctctgtggtgttggccagatcatacttgaaggccttggaaatggagtctgctgattagccaaaaagcccactttaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 83426 - DNA, 1047 bp, Homo sapiens
ggccttgtgggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatcctctgtggtgttggccagatcatacttgaaggccttggaaatggagtctgctgattagccaaaaagcccactttaggtagcaagctaacacttttttacatcaaagtagtaaagaagcagttaccaaacttctcag

SEQ ID NO: 83427 - DNA, 2980 bp, Homo sapiens
ggccttgtgggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggcatggggggctgggacccagcgagcccgtggctctctcaggagtagatgagtgctagaccctggacctcctgactccgagttcatgtagtctccgctgcaccaactccaaaaccgtgggattctgcttttcatcctctgtggtgttggccagatcatacttgaaggccttggaaatggagtctgctgattagccaaaaagcccactttaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgtatcatgagt

SEQ ID NO: 83428 - DNA, 3966 bp, Homo sapiens
taccttagtaaatgcaattttcgaacaggcccccatcttcaactggtatagcatcttccacaccctgtagccttcaaacatcacctgttaaaatactgcccatgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 83429 - DNA, 5488 bp, Homo sapiens
ggccttgtgggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagctttggtatcaggatacagctagcctcatggaatgaactaggaagtatgccctcctcttctagtttttggatgacccatcatctcttacctcacctacagcaggaaccttgaaattggacttctgcctcacaccctgcaatctcatctccacattatgaccagagtgatcttcttttttaaaaaaaacttattgttactatttcaattgataaatgaattgtatatatttatggtgtacaacgtggtattttgattgtgtacacattgtggaatggctaaatcaagctaattaacacaccattttttgtggtgagaacacttaaaatctactctcagcagttttcagatacagactacattgttattgactgtagtcaccatgttgtacagagtgatcttctcagtggacaactctgtgcacatccctcagagccgcaaggcagtgatatccaggttcctgaacagggtctccaaagccctccacccacgggtcctttccttcctgtctcgccacatcttccaggtccatgtctcagctatgtgaggttcttttcagttccttaagcacatcccactgttagctcagagatatgttgcagtcctaactccaagtacctataaatgtggccttatttcacaatagggtctttgtaaatgtaattaagttaggatgtggtcatattgaattggggggtgggggttaagccaaatgactgtgtccttagaagaagaggagaagagacagacacagacaaaggaaagaaggtcaggtggaaatggaggcagagatcagaatgatgtgtgtataagccaagaacacctgggactatcggaacctggggcagccaaggaaggatcctcccctagagtgttcggaggaagcatggcactgccgataccttgaattcagacttccagcctccagaactaggagagaataaacttctgttgttttaagccactgagtttgtggttctttttccagcagccctaggaaactcatacaaggatataggaggtttatttgcagatgagtttgttgcttctttagtggtctgtatctcatagcactagaaagaatagaaaagttaattccagataatgtgatgtatttgttttgtttttcgtagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 83430 - DNA, 4382 bp, Homo sapiens
ggccttgtgggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggcatggggggctgggacccagcgagcccgtggctctctcaggagtagatgagtgctagaccctggacctcctgactccgagttcatgtagtctccgctgcaccaactccaaaaccgtgggattctgcttttcatcctctgtggtgttggccagatcatacttgaaggccttggaaatggagtctgctgattagccaaaaagcccactttaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 83431 - DNA, 4332 bp, Homo sapiens
tttgcatgtattttcataagggatgttaatctgtggttttctcttcttgtgatgtctttgtctagctttggtatcaggatacagctagcctcatggaatgaactaggaagtatgccctcctcttctagtttttggatgacccatcatctcttacctcacctacagcaggaaccttgaaattggacttctgcctcacaccctgcaatctcatctccacattatgaccagagtgatcttcttttttaaaaaaaacttattgttactatttcaattgataaatgaattgtatatatttatggtgtacaacgtggtattttgattgtgtacacattgtggaatggctaaatcaagctaattaacacaccattttttgtggtgagaacacttaaaatctactctcagcagttttcagatacagactacattgttattgactgtagtcaccatgttgtacagagtgatcttctcagtggacaactctgtgcacatccctcagagccgcaaggcagtgatatccaggttcctgaacagggtctccaaagccctccacccacgggtcctttccttcctgtctcgccacatcttccaggtccatgtctcagctatgtgaggttcttttcagttccttaagcacatcccactgttagctcagagatatgttgcagtcctaactccaagtacctataaatgtggccttatttcacaatagggtctttgtaaatgtaattaagttaggatgtggtcatattgaattggggggtgggggttaagccaaatgactgtgtccttagaagaagaggagaagagacagacacagacaaaggaaagaaggtcaggtggaaatggaggcagagatcagaatgatgtgtgtataagccaagaacacctgggactatcggaacctggggcagccaaggaaggatcctcccctagagtgttcggaggaagcatggcactgccgataccttgaattcagacttccagcctccagaactaggagagaataaacttctgttgttttaagccactgagtttgtggttctttttccagcagccctaggaaactcatacaaggatataggaggtttatttgcagatgagtttgttgcttctttagtggtctgtatctcatagcactagaaagaatagaaaagttaattccagataatgtgatgtatttgttttgtttttcgtagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 83432 - DNA, 3972 bp, Homo sapiens
taccttagtaaatgcaattttcgaacaggcccccatcttcaactggtatagcatcttccacaccctgtagccttcaaacatcacctgttaaaatactgcccatgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcatacacgtcatatcgtagtacagtccgttggttgtggccgttttgtc

SEQ ID NO: 83433 - DNA, 794 bp, Homo sapiens
ccaacagcatttccatgtggaaacgctgtggtaggaggatggcctgataatgcagctttgtctctgctccctccagatgcccattcaccagaatctcaaggagctgctggccgtcagggcggagctgcagaagcgtgtggagggtctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttac

SEQ ID NO: 83434 - DNA, 850 bp, Homo sapiens
ctttcgggttctaggcagccgtgggcgctgcgacccttctctcactgtcagaggggcgggagctctcggcctgcgccgcctccgctgcctgcttggtcgcgggcttgccgggaatggtgacagcccgggccccctcttggccaaagaagtcctcgaaagcgttcggcgcacgggctttgtccagctttttaaaccgtaacaaggaccggggccgggcgcggtggctcacgcctgtaatcccagcattttgggaagtcgaggcggacggattacttgaggtcatgagttcgagaccagcctggccaacacgatggagtcttgctcccatgctggagtgcagtggcgtgatctcggctgactgtaacctccgcctcccgggttcaagtgattctcctgcctcagcctccggagtagctgggattacagcaaagatatccagacgctgtatgcaggaagaactgaatttcagaggacaccgtttgatcttcaacacctggcagtttacaaaacagagacggggtgtcgccatgttgcccaggctggtctcgaactctggagctcaagcgatctgcctgcctcggcctttcaaagtgctgagactacagcctgaagaggagagggggaatcctggtgagaagcatttggaattcaagctcagagaagaagacacggagtcccagctgagaactcaaactggtagaaggaagattatttttccttctctataggtgcttggaggtaacgaggggaaaggagttgaaaggaaggtgacatttcaggtattgatgggacagcacgtgcgaggcctagaggactgaaagttcttgatgggatctgtcagaagaaaaca

SEQ ID NO: 83435 - DNA, 207 bp, Homo sapiens
aaaagcaaattaaaacaaaaaagagatgccacttttcaataactggcaaaaattataaagagtaaccatatctgcgccaggcacggtggctcatgcctgtaatctcagcactttgggaggccaagggaggcagacaactttgagctcaggagttcgagaccagcctggacaacatggtgaaccccatctctacaagaattacaaaaa

SEQ ID NO: 83436 - DNA, 3883 bp, Homo sapiens
caacaaaatacatacatatatatatatttcaggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgcttggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcatcttcacaccaacatgcagaaaagtttctaatctcagatcagggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctaccccaaaaaaaaattaaaaattagccaagcatggtgatgatataggagttaaggagaaatcatttaggcaaatagcaagggtaggaagtcctcagtgaggttttctgtttaatgaaaagcagcccccaaaatcattttcttttctaacaaagaacagcctgtaaaatcgagctgcagacatagacaagcaagctggaagcttccacgggtgaatgctggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatactaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaagtagctgaaactacaggtgtgtaccaccacacctggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtctgtataagctcaatgagtattgatttaggggctttggagaactttgaatgctaccccccaagtaaccattattggcaacctggtacctctacttttagccatttctccttctctataaacagtgcagaagtaacccacttggtaacaggcatccttgccaagcctccaccactaggtcagtgtaagaattaaagaaagaggaaagaaacacgaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgtttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgggacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcagatacagacacacctcagagatattgcaggctccactccagatcaccacaataatgtgaatattgcaataaagcaagtcatacacatt

SEQ ID NO: 83437 - DNA, 587 bp, Homo sapiens
cgggcagatcatgaggtcaggagatcaagactatcctggctaacatggtgaaaccctgtctctactaaaaatacaaaaattagccaggcgtggtggtgggtgcctgtactcgggaggctgagacaggagaatcgctcgaacccgggaggcagaggtggcagtgagctgagattgcaccgccacactccagcctgggcaacagagcaagaccctgtctgaaaaaaaaaaaaaaagagataacaggtttcaaaatctattcaacaaatcttctgtggttttctgaaggtgaatttagttctctttctggtgactctctggattttgaaaaacagactctcctccctcaatagtgaagtgtccaccctccggaacacaaggtaagatggagaagggggtgataaccacacagacatgtatggttcccaagagccaagccatgtgcctcagcagccactgaggtcccttctcagggtcttttgaagggacccagaaaaaacagacgcagccatccttctatggcagccatcacagattcagtggtatcctgttgagaccccatgcaacatgttttgtccatgtctaatctc

SEQ ID NO: 83438 - DNA, 6775 bp, Homo sapiens
agcggggggtgtctgctctgtgcagtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttcacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgcttggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcatcttcacaccaacatgcagaaaagtttctaatctcagatcagggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctaccccaaaaaaaaattaaaaattagccaagcatggtgatgatataggagttaaggagaaatcatttaggcaaatagcaagggtaggaagtcctcagtgaggttttctgtttaatgaaaagcagcccccaaaatcattttcttttctaacaaagaacagcctgtaaaatcgagctgcagacatagacaagcaagctggaagcttccacgggtgaatgctggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatactaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaagtagctgaaactacaggtgtgtaccaccacacctggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtctgtataagctcaatgagtattgatttaggggctttggagaactttgaatgctaccccccaagtaaccattattggcaacctggtacctctacttttagccatttctccttctctataaacagtgcagaagtaacccacttggtaacaggcatccttgccaagcctccaccactaggtcagtgtaagaattaaagaaagaggaaagaaacacgaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgtttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgggacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcagatacagacacacctcagagatattgcaggctccactccagatcaccacaataatgtgaatattgcaataaagcaagtcatacacatt

SEQ ID NO: 83439 - DNA, 6230 bp, Homo sapiens
agcggggggtgtctgctctgtgcagtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttcacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgcttggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcatcttcacaccaacatgcagaaaagtttctaatctcagatcagggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctaccccaaaaaaaaattaaaaattagccaagcatggtgatgatataggagttaaggagaaatcatttaggcaaatagcaagggtaggaagtcctcagtgaggttttctgtttaatgaaaagcagcccccaaaatcattttcttttctaacaaagaacagcctgtaaaatcgagctgcagacatagacaagcaagctggaagcttccacgggtgaatgctggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatactaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaagtagctgaaactacaggtgtgtaccaccacacctggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtctgtataagctcaatgagtattgatttaggggctttggagaactttgaatgctaccccccaagtaaccattattggcaacctggtacctctacttttagccatttctccttctctataaacagtgcagaagtaacccacttggtaacaggcatccttgccaagcctccaccactaggtcagtgtaagaattaaagaaagaggaaagaaacacgaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgtttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgggacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcagatacagacacacctcagagatattgcaggctccactccagatcaccacaataatgtgaatattgcaataaagcaagtcatacacatt

SEQ ID NO: 83440 - DNA, 6595 bp, Homo sapiens
agcggggggtgtctgctctgtgcagtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttcacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgcttggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcatcttcacaccaacatgcagaaaagtttctaatctcagatcagggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctaccccaaaaaaaaattaaaaattagccaagcatggtgatgatataggagttaaggagaaatcatttaggcaaatagcaagggtaggaagtcctcagtgaggttttctgtttaatgaaaagcagcccccaaaatcattttcttttctaacaaagaacagcctgtaaaatcgagctgcagacatagacaagcaagctggaagcttccacgggtgaatgctggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatactaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaagtagctgaaactacaggtgtgtaccaccacacctggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtctgtataagctcaatgagtattgatttaggggctttggagaactttgaatgctaccccccaagtaaccattattggcaacctggtacctctacttttagccatttctccttctctataaacagtgcagaagtaacccacttggtaacaggcatccttgccaagcctccaccactaggtcagtgtaagaattaaagaaagaggaaagaaacacgaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgtttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgggacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcagatacagacacacctcagagatattgcaggctccactccagatcaccacaataatgtgaatattgcaataaagcaagtcatacacatt

SEQ ID NO: 83441 - DNA, 4190 bp, Homo sapiens
  misc_feature (22)..(23): n is a, c, g, or t
  misc_feature (71)..(71): n is a, c, g, or t
ttaaagcataactgtatttttnnttttagggccttattgatgttttgccgttccaatgtatgcattttttnactcaataaacttgtcttaattttaaatatggggcttccttggacctgtctgcgccatcttctctgtgaatttagttctctttctggtgactctctggattttgaaaaacagactctcctccctcaatagtgaagtgtccaccctccggaacacaaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgcttggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcatcttcacaccaacatgcagaaaagtttctaatctcagatcagggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctaccccaaaaaaaaattaaaaattagccaagcatggtgatgatataggagttaaggagaaatcatttaggcaaatagcaagggtaggaagtcctcagtgaggttttctgtttaatgaaaagcagcccccaaaatcattttcttttctaacaaagaacagcctgtaaaatcgagctgcagacatagacaagcaagctggaagcttccacgggtgaatgctggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatactaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaagtagctgaaactacaggtgtgtaccaccacacctggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtctgtataagctcaatgagtattgatttaggggctttggagaactttgaatgctaccccccaagtaaccattattggcaacctggtacctctacttttagccatttctccttctctataaacagtgcagaagtaacccacttggtaacaggcatccttgccaagcctccaccactaggtcagtgtaagaattaaagaaagaggaaagaaacacgaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgtttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgggacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcagatacagacacacctcagagatattgcaggctccactccagatcaccacaataatgtgaatattgcaataaagcaagtcatacacatt

SEQ ID NO: 83442 - DNA, 585 bp, Homo sapiens
gaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtattgacagcggtgttccagagggctcccttccttgacgcaggacacgctggctcatggaatgatgcggcatttgattccttaatataatagcccggctgggcgtggtggctcatgcctgtaatcccagcactttgggagactgaggtgggcggatcacctcaggtcgggagtttgagaccagcctgaccaacatggagaaaccccgtctctactaaaaatacaaaattagccaggcatggtggcgcatacctgtaatcccagttactcaggaggctgaggcaagagaatctcttgaacccaggaggtggaggttgtggtaagccgagatcgcaccattgcatgccagcctgggcaacaagagtgaaattccgtctcaaaaaaaaaaaa

SEQ ID NO: 83443 - DNA, 658 bp, Homo sapiens
ccgtggagtagattaggcgtaggtagaagtagaggttaaggagggtgatggtggctgtgaggtgggggaatgtggttctcccttgagaaatgggttccagagagctcgaagctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttcacctggatgctgctggaggccctgtacctcttcctcactgcacggaacctgacggtggtcaactactcaagcatcaacagattcatgaagaagctcatgttccctgtgggctacccagtgaacaactgagagcccaggcacatattgagccgccgtcccaggcactccaccatttaaggaacaccttcccagcgacttggccgagcagtcagcacctcccagagtgtcacatcctaagccccacactgcatcc

SEQ ID NO: 83444 - DNA, 6541 bp, Homo sapiens
agcggggggtgtctgctctgtgcagtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttcacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagatgttatggaaggcgtgcttggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcatcttcacaccaacatgcagaaaagtttctaatctcagatcagggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctaccccaaaaaaaaattaaaaattagccaagcatggtgatgatataggagttaaggagaaatcatttaggcaaatagcaagggtaggaagtcctcagtgaggttttctgtttaatgaaaagcagcccccaaaatcattttcttttctaacaaagaacagcctgtaaaatcgagctgcagacatagacaagcaagctggaagcttccacgggtgaatgctggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatactaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaagtagctgaaactacaggtgtgtaccaccacacctggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtctgtataagctcaatgagtattgatttaggggctttggagaactttgaatgctaccccccaagtaaccattattggcaacctggtacctctacttttagccatttctccttctctataaacagtgcagaagtaacccacttggtaacaggcatccttgccaagcctccaccactaggtcagtgtaagaattaaagaaagaggaaagaaacacgaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgtttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgggacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcagatacagacacacctcagagatattgcaggctccactccagatcaccacaataatgtgaatattgcaataaagcaagtcatacacatt

SEQ ID NO: 83445 - DNA, 3045 bp, Homo sapiens
agcggggggtgtctgctctgtgcagtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttcacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggtaagatcacgcattgctccagagcacttcactaaccgacccacctgaggagcatgtgcctatcacacaaggaaacctgggaatacagcaggcaatgccctagaaaggctcgcatctgagtacgccttgactcattaaccattagcaatgatctcagtttaaatgtttttttttaatcagtcatagcctgtcatcccggcatcactgtcatcccagcatttgggaggcctaggcaagaggatcacctgaggccaggagtgcaagatgaccctgggcaacatagcaagatcccatctctaca

SEQ ID NO: 83446 - DNA, 4552 bp, Homo sapiens
gggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgtagagatagagtttcatcatgttggccaggatggtctcgatctcctgaccttgtgatccgcctgcctcggcctcccaaagtgctggattacaggtgtgagccaccacgatcagcctctagtgtttaaaaaagaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgcta

SEQ ID NO: 83447 - DNA, 4420 bp, Homo sapiens
gggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgcta

SEQ ID NO: 83448 - DNA, 609 bp, Homo sapiens
gggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgaacgtccagttgcggataatgagcgaatgtttgatgttcttcaacgatttggaagtcagaggaacgaagttcgcttcttccttcgtcatgaacgcccccctggcagggacattggtaggtagtgctctgtgaatcgtgacagatatttaagcttttattttgtgctgggagtagtaggtggcac

SEQ ID NO: 83449 - DNA, 4063 bp, Homo sapiens
catgtttctccggggagaaactggagaatagcacgtccggcagaaatagtgttcctgatccagctttgaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgcta

SEQ ID NO: 83450 - DNA, 3369 bp, Homo sapiens
agaaaacagatgctgtttatggatccttaaaagacaatccgctgcttttttactttttaatgttattacctgtgtagctctgtttgtctctaatacttgtaataaagtgtgggtgagagttcattggggagtgtttattttggaatgttttttgtagactctatggctagattctgaaactgctcattttaaaaagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgcta

SEQ ID NO: 83451 - DNA, 4618 bp, Homo sapiens
gggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgctagctgtttactggtttttgtttttgatgtcataaatagaccttgtttaatagtcacaagccgttgggatatcatacccagctgaaaaagaacaaactgcttaacataagtatatgtatcgtaataagagttttttaccagctaagtgattcaatgtaagtggtttttaaaataaaatactgtagagatcaaaaaaaaaa

SEQ ID NO: 83452 - DNA, 2620 bp, Homo sapiens
gggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgcta

SEQ ID NO: 83453 - DNA, 4366 bp, Homo sapiens
gggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcagtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgcta

SEQ ID NO: 83454 - DNA, 1041 bp, Homo sapiens
agtcagactcatagagagatccccatccgaatatgagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgcta

SEQ ID NO: 83455 - DNA, 698 bp, Homo sapiens
cagcgctaacccaattccattccagcgtcatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgcta

SEQ ID NO: 83456 - DNA, 1655 bp, Homo sapiens
gggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggtaaaaagtcctgcacagcctagttcttcctgtccccactattctttctcccaagtttgagtttaaaaaaaatctctctttgtattcattattcatgtttgaattctaaaaatccttttatattctttgctggtgtaatgagacgtttaaaaaattaaaattgataccctggttgtacaa

SEQ ID NO: 83457 - DNA, 307 bp, Homo sapiens
gtaaggttcttaacgttcataggtgacgtgcttaagttctataccagaacttaagccatccctcagcagacagcaaaataactaatccctattttgactgacgctaagggtttttaactgtggcttctgttctttactgggagtttaaaagagtgcttgctaaatgtctgctcctacagtagtaggcactaaagataatagatgaataaagtgtggtctcaagtctggaggggcttatcggtgagggagaaccaaatataatgggtcattacagtgcagaaggaaggtgtgtgtcttcactgtaggt

SEQ ID NO: 83458 - DNA, 474 bp, Homo sapiens
actcagtgctcccaatttctttatggtatgtgacaagtagaactaaatgtattgattactgcattcatttattctgtatctccagggtataattcaataagtatttttgtttggaaaaaatcttgtgttatccatagtcttgggccttgaaaatacaacagccttggtcacagataatacagcttctgtttgtatgcttagaaacagctattgtcagggacttcttcaattacaaaagacagtgttgcagcatctgacctagtggtgttaatgactttgaccatcaaaagaccctctattaaggctttagtacttatagattgatggtgtatccttgcaaataagtaaacagacccccctctcctaacaacatgatcaagagaagtgaaggatcagtttaagaacccaaatggtccaagttttcctaaaaatcaaacttgtcataaagtgaaataaaggcaacatatattttgg

SEQ ID NO: 83459 - DNA, 392 bp, Homo sapiens
gggaggagggaaaaagatgaccagcccagtgaggttactcataggcatcttcttcagaatcattactcagtgtgccctcagaaaacagatgctgtttatggatccttaaaagacaatccgctgcttttttactttttaatgttattacctgtgtagctctgtttgtctctaatacttgtaataaagtgtgggtgagagttcattggggagtgtttattttggaatgttttttgtagactctatggctagattctgaaactgctcattttaaaaagtaagaaaatgtcacatcttagtttctaagtctgatcacctgagatgatttttaatactaaaggacctgtgcttctttcctaaggtttcatctgatggaaatcttccccagcaagccg

SEQ ID NO: 83460 - DNA, 407 bp, Homo sapiens
gaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaaa

SEQ ID NO: 83461 - DNA, 539 bp, Homo sapiens
aatgaattttaaaaataggtagcacacggaagttattgtataattcattcaggtgtccatcgctaagcccccaccacaaacagaaactgggataatcaggttaactcggcactctcagcatgccccccaaatatcaaaaatatctttctgaagctattccctctgcatgtggacaaattccaagtgctttcttcattcttagcacaaagaatgttctaatattctgaggcaagtaaaaataccacaattccaaaattttgtctctggatgtataactagccagcaacaaattaatgtagagttttgcatgctctcttgtgtttttacactttttcatgggctatttgtcaacatttactcctagctcctgaaccgccccaagttctgcaggagctccagcctgtcactgtgcagtctggcaagcctgcccgcttctgtgccatgatatccggaagaccacagcccaaaatttcctggtacaaggaagagcagctgctttccactggcttcaagtgcaaatttcttcatgatgggcaaga

SEQ ID NO: 83462 - DNA, 483 bp, Homo sapiens
aggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccatgatatccggaagaccacagcccaaaatttcctggtacaaggaagagcagctgctttccactggcttcaagtgcaaatttcttcatgatgggcaaga

SEQ ID NO: 83463 - DNA, 1053 bp, Homo sapiens
ttggtgacacattgctggtcagccaatcagaggctggtattaaggggaaaacagaaataatttctgtcccctgaattctctaagatttgtgaaagaaaaaatagtatcccccctaaaaaaaaaacaaaagaaaacctgaccccagagagatgctgcaaaaatttccgaaagtaaaacctgggccactcactggaacatagtgcagtgtctcctgagaggttagtcattgagcagttaagtgagcaggctggggtgggagaatctctcacgtgattggatgacctgacttgacacataagtcagacacatctgttttttaatcatcactgctacaccctgggttcgtcaccttgaaaagatttgttcacttatattgatttcaatttcttaaactgtaaattgcattttattagtagagcttgaaaggttcaaaaacatttacaaagggcataaaagtggtgggtttcaaaaaatattaatatctaatcatatatttcgtatgttaaaaattcttacttacctttttctttcccagagagagtttaggaattttctcaggtgtgttttctgtaggtgatttcaaacagaattccaaggctcagcttttagaatgctaccaaggaaaataatagggaaaatctccttcgattttggctgtagaaaatgaatacatttccacgaggaaatattgtagataattggtgagttacataaatttataaaacattagttcctctttctgcagggtaaatttctgagagtgaatatctctgttctgtatcctgttatcttgatttctgagtttcatactaaatttcatgagatgaaacttggtacctcctagaagtttttccctatgactaattgtttactacattatttttaatagaaataatacaataataaatttattatctgaaagaaatagatacttttgctactcgggaggctgaggaggcaggacaatcgcttgaacccgggaggcagagtttgcattgagccaagactgtgccattgcactacagcctgggtgacaaagtgagactctgtctc

SEQ ID NO: 83464 - DNA, 709 bp, Homo sapiens
ctttcagacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtgtgttttctgtaggtgatttcaaacagaattccaaggctcagcttttagaatgctaccaaggaaaataatagggaaaatctccttcgattttggctgtagaaaatgaatacatttccacgaggaaatattgtagataattggtgagttacataaatttataaaacattagttcctctttctgcagggtaaatttctgagagtgaatatctctgttctgtatcctgttatcttgatttctgagtttcatactaaatttcatgagatgaaacttggtacctcctagaagtttttccctatgactaattgtttactacattatttttaatagaaataatacaataataaatttattatctgaaagaaatagatacttttgctactcgggaggctgaggaggcaggacaatcgcttgaacccgggaggcagagtttgcattgagccaagactgtgccattgcactacagcctgggtgacaaagtgagactctgtctc

SEQ ID NO: 83465 - DNA, 589 bp, Homo sapiens
tgggatgtttcttatatccctgcacaccatagataaatacggtcatatgggtatcacccatttcagctcttccagaaggagaaatgtttttacttatttatttttgagacagggtctcactctgtcacccagatagaaattcgaggtaaccagaaatttagttaccctttctgcacccccccaagtgtatgaagccaaaatgctctccagcagaggcaacagcctttatttccttgaagccctggcctacagttcatctcttccagaaagattctcttaacgaatctcactccatccccatctgacttgtattttttgcattcctttagccagtacccaatagtcagttgggggttaattttttatatgtttttacttacttcacgcagttttcccatttgcaaattttttgtttgtttttgtttttgttttgaggcagaatctcactcactctgtcgcccaggctggagtgcaatggcgcagtcttggctcactgcaacctccagcctgggtgacagagtgaaattctgtctcaaaaaaaaaaagtaaaagaaaaggaaacaaaattccccactgcccccaaagtcac

SEQ ID NO: 83466 - DNA, 350 bp, Homo sapiens
aataaaaatccaggagtccacatggttataaataagtacctgaataaataaataaatgaaggcagctcttccttacagaagagttccaattaataaatgtgacatgaacaagggaaataaaaaaacaccattagaacaccacagtaataattattgcagacaagacgcactgatgtatgctaaaattaatgggtgaaagtttgaggagaagcagcatgttcgaattgtctcaaagtatctcccccaagagatttactaattataaaggggaaagaaaatacagtaatctgcagtggagaaacccagtaggtgccaccttaatcaagtgaccaagttaacatcaccagtaa

SEQ ID NO: 83467 - DNA, 413 bp, Homo sapiens
actttggtacagaggaacacaaatacatcctgagttaactgtgacttgtttattacatttacacaaaaatattttaccaagtcagtgtgcacacattcatttctgattagattttcattttaattatattgagatcccaagcaatgatagtatagttaattagacataaataatgacatatttctgtcatcaaaatcttctgaaaactctaaataggtaataaaacattatgcaattatggtgtaatcagcacaaaagtactgggaaataaatacatccataagtgcattttcatctaaacttgtgattgctttgctcctcactctctttctctgtatgcaggcgccttaaggctgaacgtcagtccttgtgatttttactctattaatacctgttcttaaattccttttctc

SEQ ID NO: 83468 - DNA, 276 bp, Homo sapiens
atttttttcccatagcacgtatcactctctcatgtgttacctgctacactagaattatgacccctaagagggaagagactatgtcagtatcattgattcttattaacaccattatttagaaccatgcttggcttaaagtagtagctgctcagtaaatatttatctatgtgtgaatttttaagttcttcctttatattgaattaaaattagtctcttgtgtgcagcagtctgggtttgtcttatgttgaaatacttatgttgacttctacatacatt

SEQ ID NO: 83469 - DNA, 993 bp, Homo sapiens
tgggtatcctgcagaagaagctggcatctttcaacatggagcttaatacacacctgggccatcagtcagagaagctggagtacaattcaggcaaaaatacatgcagttgtagggttggctgctgtcccacgccaatgaaggaagcccatagataagcagagtgtatgatgaaaaaaacacccactataactttctgtgatggttaaatttatgtgccaacttgaatgggttaagggatactcagggataagggatgctcagcccaacttgagtgggctaagggatgctccgatagctggaaaaaacattctttctgggtgtgtctgtaaagaggtttgcatttgaattaatagactgaacaaagaagattcaccctcaccagtgcagatgggcatcatccaatccattgaggacctgcctgaataaaatgaaaaggcaaaggaagggcgaattcactctctcctcttgaaccagtacattcatcttctcctatgcttgggcactgatggtcgtggttcttgggccctcagacttagaccagcaacacccccaaccaaccctcttcaggacccctaacccctccttcccaggttcttaggcctttggacttgaattaattacacgactgggttttctgattctccagctctcagaaggcagattgtgggacttttggggcctcataattgcatgagccaattcctataataaattgcctcttataaaaaacacatcccaccacaccccacaccaccacagcaacaagaacaaccagagagggggcggccaataaaaagatcaccccagagcggagccacaactcagggcgacagcccacgagtagagttgcaaaaaggggcgcccaacagagcagcacacatatacaaagacacagaccaaatggccgcacctactaaaaaccgcagcgagccgcggaacacaacaagccatccacagagacaacaagccggagaacgcaccacactcacaccc

SEQ ID NO: 83470 - DNA, 493 bp, Homo sapiens
caaaatctggcatccctttacgattaaaactcttagcaaagtcggcatacaaggaacatacctcaatataataaaagccatctacgacaaacccacaaccagcataataatgaatgaggaaaagttgcaagcattccctctgagaactggaacaagacaaggatgcccaatctcaccacccctcttcagcatagtactggaagtcctagccagagcaatcagacaagagaaagaaataaagggcatccaaatcagtaaagagaaagtcaaactgtccctgtttgctgttgatatcatttaccttgaaaaccccaaagacgactccagaaagctcctagaactgatagaagaatttggcaaagtttctggatacaatattaaggtatagaaatcagtagctcttctatacttcaacagtgaccaagcagagaatcaaatcaagaattcaaccccttttacaatagctgcaaacaaacaaacaaacaaaaaaaaa

SEQ ID NO: 83471 - DNA, 783 bp, Homo sapiens
gtcctattcccattgtagaggctaggaaactgatctccaagacgttaggtaagttaacagggcttgtagtggcagaaccagattgcagactgcaggctagtttctcggcctgtgttggtttccctttgccatgctgtatgtaggcgacaatggtctgctgagcactcccgggagcctgagcctcagggctggctcctgtggatgctggtcacagctgaccacaggccacctgtttgttccctgactttcctgttcatcagggcaggcatctgcatctcatctttccgtaatcagcatcagcatcctctagccagaaactgctggtgacatggactagcagttgcccatttcattggggaagctccttttgaggggacagaatccaacttctggtgagtgtagacaaattctcagccaactttccttgattttctggcaagtgtttcctgaccatatccaccttcagagatatgaaacttttagagacagataagttttccccggtggtcctttctcacctcattcttacctgtgaatacacttggggaccctgaatgacacccaaactcatagcaggctttttcacaatacttaccaacaccattactccagtcagcagcccaaagaaacatcaggctccacactaaaaatgtcttctttataacaggcaacgttgcttcaaacatgggttggaacacacacttagcaccagattgcatccccagtgttgaaatcaggatccacattgatccatcattaacccactatacccgggtggcattg

SEQ ID NO: 83472 - DNA, 315 bp, Homo sapiens
ctaccgctagctctcaagagctactgatcccctgaaatactacagaagctagtgaatgcactactcatttggtttacatacaataccctgtgctgtgggcatgtattatctcccaaatgagacttcttgagagcagaggacctgtgagctatcttttcccccatgacatctagtatactaccctaatgcttaattgcatttactgagtacctaccaagtgccaagctttgtgctgggccctaagaaatccacgatgtctaagacaaaatcccaactcttggctgggcatggtagctcatgcctgtaatctcagga

SEQ ID NO: 83473 - DNA, 807 bp, Homo sapiens
aactacagtgtcgtagtgactaattaggtaaatacaacactttcatttcatagaaactcaagacatctgcaatttggaggtagcaatatggtcatttttattcaaatcctgttttgttttcatgaaataaaaattgcaatgctgattttcacatctgggcagttgggtgtcaacaaatcgagaacaaactgtcaaccaagtaaacaatagaactttcaattctgaaaactgattttgatgaagagtaatttcttaaagaaggatgatcactccaaaaatttcctgattatgttctgaaatctttcagtaaaaatcattaacaagatcatacagtctctgttatttgtgtgggaaaatataacaagtcaactatttgaagccaaaattaacctattgtttgactgtacaactcctttcatcaaagaatgacactgaagatatcagtggcacaaacagaagaactgatgaaaaataaatgccttctctataccctgaaatacacctgttatttctgttcacaagtcctgattttatcatctcaacttattaatgaatatagtatctaaccaggctttcagaagacaaggaatttgtgatgttttgcagcttctttttttattattattttgagctgtacagtggctttcttgactcatcagcagacatcgtggggatctctacgcaaaaaacctggagtgcatgccattatcaagtttgatattaacaggtgtgttaaagaaatatgtttgcactctaccaagacagagaggccttagttagtacttgattcccctttactcacgagaa

SEQ ID NO: 83474 - DNA, 112 bp, Homo sapiens
gctgtatgttatattgctttatcaaaaagcaattaaccaaccatattgtggccaccagtcatgtaagagtatacatatttcatgactaacttttgggttttgggtacttttt

SEQ ID NO: 83475 - DNA, 436 bp, Homo sapiens
ttacaattgcatttattatagaaatgaaccacttggtatttttcagcaagcaaacatttggaaacagtgttttagaaagattaattttgcaatatcataaaggatgaattggaaggaagaagattccagagatggagaaataaattaggagtttataataatctatttgtgaaataaaactgaaaagggggatgagattggaatagaaaagaaaggcaataagagaatgcaactgaaaaatcaataggacatgtccactaatgcaaccgcccaaggggttcactttgccagccacctagacagaaccgattcatcaagacgggaattgcaaaagataaagagtaattcagacagagccagctgtgcgggagacaggagttttattattactcaaatcagtctccctaggcattcggggagcagagttttaaggata

SEQ ID NO: 83476 - DNA, 492 bp, Homo sapiens
gtgagtctgccatgcagggcagttactatggtaaaacatattttggctccagaaactgaatttacagttggagtagctgactcaaaagttacttgcttaaaattaaaagtatgagaaaccccaaaaaatctctttattctactacatactgcacaatatcaagaaagccaactagaaaaaaatagggcagtccttaaaactgacaaattaagccagaagtcttctaagtcagtgggaatagttaaaacaaaattgtaacagatggtagatattaaaaaaactatggctaaagccagggtaggtataaattttgttttggcaaatcagaagctgaaaatcctaataagctccaaatcattttggtaaatcgacacagttcttaaggacctgtggccccttacgtgaataaggaaaagaaaatttctctaaacatacaaggtgtggtggtatttacccagcctggaacatgtttgttttaagacgaggaggtca

SEQ ID NO: 83477 - DNA, 478 bp, Homo sapiens
ttatgaccatttatttttaaccataattttatttatataatttatatagtttatatagtttacatacatttatataatttaacttctaatgatagattttcaggaattctcagctggttgtaaaacctaacaattggctcttgcaagccaatacaagtcggctccagcacacccctgagattgctacactgcaagatactacagacactatttttcccaggaaaatcacagtcattatttccttaatgaaaatccagctctctctgtgttttcagcagtccataggtatgtttgtgtggcaacagtaggtgtctgtattcacagctccttgggcttggcgtcggggctggagagtgtgtagatgaggaaaggcacagatgttggagtcaaatagaccagtgactgctctgtgtcaaggtgtaatttcattaacctttaagccttcatttaataatatttattagctgtgggattgttg

SEQ ID NO: 83478 - DNA, 367 bp, Homo sapiens
cagtttccaaagctatgaaattactaacagggataatgatgaattcccttcagtgatgatagcggctctacagcgatgctcgagcttctgtttgagctgactgttgacatacagcatactctgcttatattgagggtaaaattcacctttgggctacagtgtgtacagtaccagatgtcttgttctgtttagcattttataaagaggaattgttccgctcattttctttagtcaaatagggatttttttaagcctaaaagtgatgcttgaaagaagattcagatgtgagaagtaaacagcagttggggggcagttaaaacaccagggaacaatgcggctgccccataaaaatgtgctcccacttgca

SEQ ID NO: 83479 - DNA, 389 bp, Homo sapiens
taagaaataagttatttcatattcaagttaaaaatatgatttgatgactttacttgtcagcttgtttattgtaacagagaaggtagtggtgaaaatttccagcttgtttagttgaataaccaataaacagatcatctaaattaaaacaatctgatcttgacttcacagagatgaagaagaaagttttatcttttatctctactgctattccatgtcctttggtcccaaaataatgttttggggaaagtctgtataagtctgtatgcacaaaggtacctcagaaggttggaaatctatacttaagaatatagtgttgcttaggttttgttttttttttttttttaaagtcatgcattgtctgtttgctacaaattcattatctaaacagg

SEQ ID NO: 83480 - DNA, 411 bp, Homo sapiens
tgccccttctcaaccctaacagggtttgtacctcgcctatagtacaggataattttgtgatccaaataccactgtgtgctgagtcacatggatgaagaaactaggtgttcattatctctgtccagtgggaaatcgggggcttggctccaagtcacagcacagcaagtgactctgaaatctgccacctgctccacctgctgtgagcagtgcagggttctgctagcagttggtactttaaaaaatattcgttgaataaattgtcatctgacatatagattatccaaacctgccccttctctttgtccttcctgaggctaggaactgtgtctacctcatttgcattttatcttaaatcagcacctgagaaagtccctgggaatggatttcattcttttcctacctccttccaga

SEQ ID NO: 83481 - DNA, 828 bp, Homo sapiens
gcaagtataaaaggaggtgagggagcaggtgctgcacgagtttccccaacctccagccagaagacaagcaaggcctgaggcaggcacctgtctggtttgtttggtgagcagtgagaagccaatggagccaggagaggggcagcaacagagggcagaggggtgatgaggcaggtcactggggacttgcaggcctctgcagtatagatagccctgtgggatggagatttagtctgcacttaaacatatctaaataaagcaagtttatcagcctctaattaattgccatttgggtcttgtcttagacagaagtgttccccttttctgaggacagattatctcctgaaatcaagttctgaccagagtggcccttcagacttctggttctaagcctttcctaaccatctggttcatcctgaatgccttgtacttttgttaaaaagctgccagaatggcatatctatgctcttgtatctcttagaaaatgtatctttctggtgcctctaaagatccccattcctagcaagtgactagactagctgatctgaatagctcaggtctctagattagtcctcatttggtgtccccactccatccccattcctatcacacatccctggatcccattccttatgggtagttctgaaaaataagagctagtttggggacaagcacctaacaattgttcctaggttgccagtcattaggcaacattatagtaaagaagggcctggcagagactagagctgctatatcgtgacttgagggactggtgttattttcatttgtttcaccctcctgttgacatttaatgttacccaaaatcaactc

SEQ ID NO: 83482 - DNA, 875 bp, Homo sapiens
gcaagtataaaaggaggtgagggagcaggtgctgcacgagtttccccaacctccagccagaagacaagcaaggcctgaggcaggcacctgtctggtttgtttggtgagcagtgagaagccaatggagccaggagaggggcagcaacagagggcagaggggtgatgaggcaggtcactggggacttgcaggcctctgcagtatagatagccctgtgggatggagatttagtctgcacttaaacatatctaaataaagcaagtttatcagcctctaattaattgccatttgggtcttgtcttagacagaagtgttccccttttctgaggacagattatctcctgaaatcaagttctgaccagagtggcccttcagacttctggttctaagcctttcctaaccatctggttcatcctgaatgccttgtacttttgttaaaaagctgccagaatggcatatctactgcttatgaccttgaaggcctgcatttttttcaaagaaacatctactgctcttgtatctcttagaaaatgtatctttctggtgcctctaaagatccccattcctagcaagtgactagactagctgatctgaatagctcaggtctctagattagtcctcatttggtgtccccactccatccccattcctatcacacatccctggatcccattccttatgggtagttctgaaaaataagagctagtttggggacaagcacctaacaattgttcctaggttgccagtcattaggcaacattatagtaaagaagggcctggcagagactagagctgctatatcgtgacttgagggactggtgttattttcatttgtttcaccctcctgttgacatttaatgttacccaaaatcaactc

SEQ ID NO: 83483 - DNA, 528 bp, Homo sapiens
gcaagtataaaaggaggtgagggagcaggtgctgcacgagtttccccaacctccagccagaagacaagcaaggcctgaggcaggcacctgtctggtttgtttggtgagcagtgagaagccaatggagccaggagaggggcagcaacagagggcagaggggtgatgaggcaggtcactggggacttgcaggcctctgcagtatagatagccctgtgggatggagatttagtctgcacttaaacatatctaaataaagcaagtttatcagcctctaattaattgccatttgggtcttgtcttagacagaagtgttccccttttctgaggacagattatctcctgaaatcaagttctgaccagagtggcccttcagacttctggttctaagcctttcctaaccatctggttcatcctgaatgccttgtacttttgttaaaaagctgccagaatggcatatctactggtaacgacccagagatgtgcatgcaactgcacgatgcgacatacactgatccgctatgctccatg

SEQ ID NO: 83484 - DNA, 547 bp, Homo sapiens
  misc_feature (193)..(193): n is a, c, g, or t
taaagccagagtggggctgacatgatgaggtggttctaaaccacatgtgcacacaagaatcatttacatagcttggaaaattcctagtgcccaggtctctcacccttgcctacctcagaatctccagggtaggcctgctatcaggatttctctatagctccccaagaaggtccagggtgcagccaagggcgtngaacccctgccatagtgggtcatatttcagttaggatgaaagactgctgaggaagctatgacaggtcagtaagaaccatcagcctgtcagctttgtttccagaagtgaccctgagccctcaagcttggtacccacatcccacatgagccactggccctctgggcgtatgtgtggataaagattaggtcggaccctgctctttttccttgcttatctgttactcagctatgaacatctgacacagaaatgggagaggttaccagccccggtgaatgttcctggtaaaatctgccctcgggaaaggctttggatttgggtgaggagtttgggcctgggctaacacagggatttgca

SEQ ID NO: 83485 - DNA, 459 bp, Homo sapiens
taatggatggagtgaggaaagccaaagaatagaattaaaagaaatcagggagtaaggaggataggttgtaaatcacatagcatgaattttcttccagaatgtttcatcagtgtagatgcttaggcgtgcaagtttaatttttgtttaaaatgggggaaaaaccctacatgaatagattcctggattaaatttagtatcagatttaatttttacagtcaagaacaattagattgtctgctcgtattttctggatcatgagatctattcacactgaaatgtctaacattttgctcattgtcaaaaaaagccttcaagtgctgacatgaagaattgtgctttatttcaaattgtgcacatcactgcagtagcagaggctcatcacacatgagagaagacatactggaagtaagattcatctcttctagttgatttgacataagcagtatcatccaactaaat

SEQ ID NO: 83486 - DNA, 417 bp, Homo sapiens
agctaagatgctcaatctctaaaaaaaaaaggatctgtattcgtgagagtagagagaaaggttgtttaggaagagtcaacagactttagcaaaatccttttatttgattcatgcataactcctgatggagtgtcaaggaagactcattcacttttctttcctgccagaaagttggttcttgcaaaatagattaacttgatgactatgtgtatattggatactcctaattttagctctgttagatatgtttctttctaaggacaagcaactatgtatagacttgttgtttgaattttttttcagtatatatatgtttcttgtttttctatttttctacttcatactgttaatgtcaaatatcaaaaatgttttccagcaatatcaagttatggcaatggcaaaagtccttgttgtaga

SEQ ID NO: 83487 - DNA, 245 bp, Homo sapiens
gccatagctcactcaatggttcaagaaagctggagcagcaattatgtgactgattaagatttaaggtaaatacctgagagagtagtgtcttcttcccagaagctggagaggtgagattggatctgctgctgccctccttgtagtgagccgaactggcaatgtcaggggagctggagactacgtgcctaactctagccactctccaacttcttcctgacttgccttggcctttttccagagcaaat

SEQ ID NO: 83488 - DNA, 473 bp, Homo sapiens
acaatctgtttcttaagtaaatcaattgtgtagtagtttgctgggctgccataataaagtataatacttgatttaaacaacagaaatttattttctcactgtgtctctttgtgtttccgaatttcctcttcatataagaacaccacgcctggctgtttttctacctttttatgtaggtgcatatataaacttccctgttagtactccttttgctgtatcccataggttttgctatgttgtatttccattatcatttgtttcaagaaaatttttaattttcttactagtttcttcattgacccactagtcattcaggagcatgttgtttaatttccatgtgtttgtatagtttccaaaattcctcttgttgttgatttctagttttattccattgcggtcagagaagatacttgaggtaattgtgatttttttttggaatttttaaagacttgctttgtggcctaacatatggt

SEQ ID NO: 83489 - DNA, 242 bp, Homo sapiens
ttactggcatttaagagtaaataaacgactccagcctgggcgacagagggagactgtctcaaaaatatatatttatccaattggctttgatttgttgtcttagatcttaaaatgttgtcagacctttgttctgatgctgcaaaatcatctgcatattatatagatgaaatcaacaaagagttatgttcttttattctatcacatttaatatcggtatgcctttggataaaggagaaaaaatc

SEQ ID NO: 83490 - DNA, 874 bp, Homo sapiens
agaggctttttctagagatgccctgctgggagagtatccatggctttgcgtccccatcatggccctgcggtcggcggcctcctcctggagcacagcaagctgagatctgtatctgtggacctgaatgttgatccctcacttcagattgacatacctgatgcgctcagtgagagagataaggtcaaatttacagtgcacacaaagaccacactgcccacatttcagaatccagagttttctgttacaaggcaacatgaggactttgtgtgactacatgacactcttattgaaacaacagactatgctgggcttatttatttccacctggttccttaagaaggccccgatttggtgggcccctcaaaaagagagtagtcgcgagaactcgtggagagaagtgtgaaggggtctagtgacccaagagaagaatgtgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggacaaaatactaaagaaatgtttggtggcttcttcaaaagtgtggtgaacagtgctgatgaagtcctttttactggagttaaggaggtagatgacttctttgagcaagagaagaacttccttattaactattacaataggatcaaagattcttgtgttgaaagctgacaaaatgaccagatctcattaaacaatgttgccgatgactatatccaaaccggcagcctgctttacatagccctggctttacgaagagcccacagtcatcaaaaagtacca

SEQ ID NO: 83491 - DNA, 322 bp, Homo sapiens
ctacatggaatcataagtgttcctaaaaaaggaagacagatttgaagacagaggaggaaggtgatgtgatgatggaaacaaggggagaaaacgcaatgtgatgtggccatgaaccaagtaatgaggacagcctacagaagctggtcaaggcaaggaaacagattctcctctaaagtccctggagagggcctggccatgctgacaccttgattttgtcccagagaaactcattttggatttctggcctccagaaaagtaagagaataatgtgctgttttaatgtcaggtttggggtaatttgttatagcagccataggaaagg

SEQ ID NO: 83492 - DNA, 365 bp, Homo sapiens
gggggttcagcgacggtcagtgccattcacaggtcactgtgatgtgggttgtggcggccaagccatggtttggggtcccgtatccctgggcttatgacatcattgtagtagcccatccccacagaaccacggtgtgtggtggcgctgaggcatcgtagatggtggaaatgctactggcttccccatgctctgccctgaggcctgactgcctcactccccttctcagttatgttccaggccccccgagcttcctggctggacagcttctctcctgggggccgttttgtcacagtgaccctgtgtttctagtcccaaatctgggtgctatagtctctttttagcgtggtggttgtcttagtcttttt

SEQ ID NO: 83493 - DNA, 810 bp, Homo sapiens
gggccagtggggccaattctgagcttgcttcctgctttctactctgtcatagaaagtatcaatataatgtcagaggttcagatctctgtgttaatattgcagagctctgacatcaatttctcattctgaagcaagttaattgttctgtaatataattgagggggtgtagggggattctaattaagtacaaaaaattatggagccaaaccgctggcattcaaatgctagttccaccacttactagctgtgtgatcttgggcaagttacttacctgtaaaatggggataattatagtacttatctcacttgatacttagcagattatgtgaatacatagacatcctcgaacagtacctggtgcaaaataagttactgtgtaactgttagcttttataaatagtattgttattcggcagagggagtccctacagaggagccaggagctgatgttaggagctacaataacatggcattctggttatataattaaatgcaagttgtttgcttttgcaaaagaaaatggaaaacaaggaagggagagccaatatttttagaactatagaaacgagagtaacaaatcttataacagggagtaacctctggttttgcgatcagctgtttttcatttataccgcagatgggcagaaaaagtactggtcaataagcataggggtttgtagagtaagatgattctgcactacatatacaagaaattgcttctggttacttgcatgcttcaaaggtttgatctagaagtttgcacataaattgagaaattagggtaagaattaaaaatgtagtaaatgaaga

SEQ ID NO: 83494 - DNA, 378 bp, Homo sapiens
cagacaatttatttttctattttccatgaagaaggagagggacaattttagattcaccagtgtgcaggacaaattcttacttaacctatagaggagcaaactttcttcaaacacattaccaatacaattgtaatactaagaatcaataccatagttctcgatgtagcatgactacaaattgtcacagtagattttggatgactttaccatagccacacttaatgaattattatttatatttctatttgtactttaataaaactatattttaaactttaaaattgtcatttaaattactaaagaaaatgagtagttcccataatgaatccataatgttaagaatttgctttagcaatgagactatattcactagctttg

SEQ ID NO: 83495 - DNA, 701 bp, Homo sapiens
tttagagttaacctttttttaaaaattagaaaagcataattttttaaaatttcccaagggacagcagtatgctacacttataccttagcttgttacagatgatgctaacttgggagtatgtttgaactgtgaagtcaaaagcaattttcatttttcaataaataaggatactacagacacccttctcccaaatgaagttagcattacattagtgtgcaagtcagtcactggtagccagtgtcatgtccacaaagccagggtacagggtaaagaatctggaagtggagaccctttcttgcaagaaaaactcacttcgaccccctatgattccatctccaacctgaccaatcagcactccccacttcccaagcccctacctagcaaattatctttaaaaactctgatgcctgaatgctcagggagactgatttgagtaataataaaactctggtctcccgcacagccagctctgcatgaattactctttctccattgcaattcccctgtcttgataaatagactctgtctaggcagcgggcaaggtgaacccattggatggctacaaactaaagaatctcaggacaagcaaaagccattccaaaggtccttgggcaagtgtctaatttccttctgctgtcatccacaagcaaaactgtagtttaccaactatcaatgcaaacaagttttaaagctgtctcaaa

SEQ ID NO: 83496 - DNA, 525 bp, Homo sapiens
gatgccttctgaccctgtggtttggcatctcactcctaccttcccttcctaggtgcttggccaagtccatacactcctgctctccagaggagccctcccaacaggtgcaggacttggaaaaagtcacctgagagaggagcagcagcggcttccacatacaggactttctaacagtcctcttgtctctaaggttaatcgtgatctggctaataattggtggagtgtccacaggaggggctaccactagccctgaaaagggtaaaacttcgatatactgacttgtccacaaattgaaggggaaaaaaaagcaagttatagacacgaagaatgtgacacccttagcaaacaaaacccattcatgcttgcataagcataaggaaggatacatttctgagtgtacacacccatgctttacaagggctgcctggtcacccaagagcagggagaccagggcagaagaagggataagacctttaactttaagctttctatattgtttcattttgtgatgacgaactcaaatta

SEQ ID NO: 83497 - DNA, 372 bp, Homo sapiens
tgttgtcctacaaaatccccatcaagtacctgcgtgtcttccacccctaccactttgagctggtgaagcccactgagtctgggaaagccgatgaagccactgccaagacccagttgtacgcaacagtcgttcggaagagcagcttcataccccgctacatcggctgcaaccacatggctctggagatctttctccggggagtcaacgagcccctggccaacaaccccaaccccatagtggtgattgcccgggtcgttcccaactacaaggaatttaaggtcagccaggctaacagggacctggcctctgtggggctgcccatcaccccactgtccttccctatcccgtccatgatgaactttgacgtgcctc

SEQ ID NO: 83498 - DNA, 1955 bp, Homo sapiens
  misc_feature (21)..(21): n is a, c, g, or t
  misc_feature (24)..(25): n is a, c, g, or t
cccgttcgacggagactctcnaannttttttttaaaggttcattattgctttctacctgctttgtcttaagcaggtagaaagccataatgaacctttaaaaaaaaaaaaagtttgagaggaaaatgtttcaaacttctctgaaagtcacttttctgtgtccaataacaattgactcacgaagcacatacgtcttatgttgcctgcaggaccgtttgcaccttttctggctttttatccatttaataatccaaagaacagacttttaagaaaagtagacttcaacgaatattgtatgtatgtagatttacagactcagtgttggaagccttagccaccaacaagtttaatcttacccacaacgttgccgagagatggtcatctacactctggaggtttccattgagcccgtgttactctgtcagggacagctgattcgattgttagccagatattagaaagttcttccttatattgtgatataatgtacctccttgtagccccagtctgtttgtccctggatgaagctagaaccattctataccctcttgaggacaacagccttccagatatttacattcaagagagactgcaaattagccccttttgggtgttttattcagtctgcagaagattttagtttttttaatacttgccaacatttaaagatcagaaagttgtatataacaaatgcagatttccagctactctttcaaatctggaagatctagtaaccatagatcttaattctcccaagtcaacaactgggctgaagctgagagcagctgtcactactagctgctttccacctggtggaagagacactttctaccacttggcctgcttcattgatagccagtaggtgccactataacatctctcttccatctatttttctcaactaccctctgccattgtgccatggtgtccagagttctcatgagttgaggttccctcctttggatatttggcagttgtactttatgcagttcagccaagaactaaacacaggccttcaggtgtggtcagagtacagtgggccagaggtcctttcttttcttcatgtggtcatacacctctgttaattcaacttaagtttatattacttttgggggtgggagtggggaagaggatcacattgttgacttgctggaagcattatgtcaactaaaatccttcagttcttattttcatcatgctgttgggttctccctatgttgtttctttttaaaaacaccaaatgcagaacttcccttttatactgcttctatttcatcttgttgacttgtagcctatcagagtatgattctttattgtcatctaaggtattctgatataatcactgcatgtctaaattctagttattgactaaatgctacttgagaccattctcttggttgtcacattattttacagttgaagaaactgaaccttagagaggttaagtaccttgttaaaggccacctggctggaacataacatcctggtcattttaactactaatgctgtcatgaaagggagttagccagggcaggtgtgaatagagcattctagcataagcagccaacaattagagcaactgtgtatttttagtgtgtggatagcaaatctttgctgtcttggaagttactatcttagaagcatggtattaagccctctattcaatgtggtgttcacatcagtagcattggtttcatttgggagctttttagaaatgcagaactcaggccccactccaggcctaaggattcaatctgcattttaagaagtgacccatatacacattaaagttttagaagcattgctgtagtatcctattttccacactttagtcatttgcatatcacttgtgcaactttggctttatctgcatacttcctgaagggggcctgcccctccacacctgtgggtatttctcgtcaggtggagatgaaagaatgagaaaagaaataagaca

SEQ ID NO: 83499 - DNA, 244 bp, Homo sapiens
agactttaagggtaaaaggaacacaatttgctgatggaatggacggtggggatatgagaacaagagcacagttaaggataaagccaaagctcttggcctgagcgatgagacacatggaatcaccaattatagggatgggaaagagtaccagagagcaggaatgggtgggaagatcaagagttgggttttggaagtttcagtgcctagcggacatcaggtggagctgttagtaggcagggggata

SEQ ID NO: 83500 - DNA, 461 bp, Homo sapiens
gaagacaaacaataaatatataatatgtcaggtggtattaaatgtatttttttgtggccatcccgcactgagacaggatgcattccacactcaaaatttggttcacatgtccagactgatagccaagttcagtggctcacgcctgtaatccagcactttgggaggccgaggtgggcagatcacgaggtcaggagatcgagaccatcctggctaacatggtgaaaccccatctctactaaaaatacaaaaaattagccaggtgtggtggtgggcacctgtagtcccagctactagggaggttaaggcgggagaaatggtgtgagcctgggacagtggcagcttgctgagtgggccatgagtaggagaccttctgtgaagccagggcagcgcccccctgctctgacgtagcgcgacgaaaaaaaaagcacattgatgtgttcgcttagggacgcgtaatcacc

SEQ ID NO: 83501 - DNA, 1008 bp, Homo sapiens
gaagacaaacaataaatatataatatgtcaggtggtattaaatgtatttttttgtggccatcccgcactgagacaggatgcattccacactcaaaatttggttcacatgtccagactgatagccaagttcagtggctcacgcctgtaatcctagtacttagggagaccaaggcaggaggatcacttgaggccaggagttcaaggccagcctgggcaacagagagagacccccatctctgcaaaaaaagaaaaaaaattttttaattatctgggcatggttgtgcacacctgttgtcccagctgctcaggaggctgaggcacgagaatcacttgagcccagaagttggaggctacagtgagctatgattgtttcattgcactgtagcctgggcaacacagtgagaccctgtctcaaaaagaaaaaaaaaatgactgatgaagccacacacacaccaacagagtatgaaagggttgttactcacataatgaagctttctggggaaagcagggcagctcctaagcaggatttgacaacagggaaggagactgacttggagttttttggtggttagggagtagggccagagtgatgtttcttgcatgtggtttgaatttcccactggtatcaaagaaggaaacacccaggcttgcttgctttatttttttaaagagatggtgtctcactatgttgcccaggctgggctcaagtcatcttcctgcctcggcctcccaaagtgctgggattacaggcatgggccaccatgtctggcgagcacccaggctttcttagcttgccagaggtgtagggcataaggggacgaggggtgggataaggcttaaaagccaccagcagtcaaacataaattaagtcagattcttaattacagatttcagatctgatttcagatcagagcttatttcaggtcagattccaggtgtagagatcatctgaagcagtcctgggcctcttcacactacagataccaacactgcctttactcttccatt

SEQ ID NO: 83502 - DNA, 666 bp, Homo sapiens
gcccgctgcccttctcttctgttctttgctctttccaagcttcctttcagtcctcctcatcagacatgacctttgaggaagtgatgagtctgctatgtgtgagacagagcccctgttgtgaagtagaactcagggttcgtcctcagaagcctcggtgggtcaccatacgtcctgcaagtgctgtcagtctgctttgattcgtgtgagggagaagtccctgccaagtgctctgtagtaggcattcaggccaaccaaagaacagggcagggtcctgaggcacaggctcagagctcttgcttatttcatggggtgtttaaattgaggtataatccctatcacagtgaacgacacgcatacttccaatcttgagtgtgccaccagagaactgttgatactccccagatctgcacccagccagggcaaactgtgcaccactcttctgacttccatggccagccgagacatttggaatctctgtgcaatcacactctgtgccatctttttttcgagacagggtctcgccctgttgcccagggtagagtgcagtggtacaatctcggctaactgcagtctcgacctcctgtgggctcaagcaatcttcccacctcagcctcccaagtagctggtactacaggtgctcaccaccatgccctgctaatttttgtg

SEQ ID NO: 83503 - DNA, 457 bp, Homo sapiens
agaagacaaaaaacccacaacccaaaggatgggattttacatctcaagacatctcctagcaaaactgcatttcccaagctcctcttctctcaatgggtcacatgacttgttctagccaatagaacgagggtggaagtaatgtgaccactttcaggtgtcccctaaagtctcctgtgagatcttccaatcttgctctcctcactctgcatggctggaaatgaatactctgatatctgaaacaacatgatgaaggagccaggatgcctaagttcaccacttagagaagagacagcttgaagagtcattctggagaactggctgaccaaactcattggattgtaacagaatataaaccttttattctgatatgccagaggcacattatggattgtattacaatgactagcattagctgtcctgattaatagacactgtgacaagattctttattgctaaa

SEQ ID NO: 83504 - DNA, 440 bp, Homo sapiens
caagaggacagcaccaggggcaacatgacaaagtttagaggggaatggaaataaaaaagaataaagcaagaggtgggtcaacagcaagaaacaagagggagaaaacgttctgactttgtgtttactttaatgtgcttctaggtggggcacagtggcttatgcctgtaaccctagtgctttgggagggaaggcaggaggactgcttgagggcagtagtttgagaacagcctgggcaacatagcatgacccctatctctacaaaaaaaatttaaaaattagccaagcatggtggcgcacagctgtagtcccagctatgcagaaagctgagatgggagggtcatttgagcccagtagttcaaggctgcagtgagctatgattacaccactgcactccagcctgggcgacacagcaagaccctgacttaaaaaaaaaggcttct

SEQ ID NO: 83505 - DNA, 715 bp, Homo sapiens
gccggctccgggcggagaagctgtcgggcgctgtcgcacaaagcgattttgtgcctcctcccggcgccttcctccactccctgccgcgttcaaggacaaacaaggacctccaaattcgtgttcaaacgccccgcgtggtaggcagtgtgggggggtcagaggagagtctggaaggaacccaaagggtgagcagacctagccagtgaagaacgcacagacatactgacccagcagcccccagaagagaagccagggaccagaagcgcagggcacgggaatgtgtcatgattggcgcacaggctgtggccccaccgctgcctgccttactcccctctgcgcgctgaccttccactcctcctgcaccgaggtccttctcaaaccagaggcttcacacctgttcttccctctggctcagatttcccatccctctttgcacacttaactgctacccgaccctcagtctcagctccagcgtgccttcctggaagaagcttccctgcccacccctccattccctttcccaggttcccacagccccctaagctgtgctttccacgtctacaatcatatatatttcttaaatgccgtataagtttccagcggctcctgtaacagatgaccacaaactggatggcttaaaacaacacgtatgcattgtctcccagctctagaggctagaaattggcagtcaggatgtgtgtaaggccacgctccc

SEQ ID NO: 83506 - DNA, 806 bp, Homo sapiens
gataactccaaggtgtgtggctttatcatctgagtgctgtggtgccattagttgagacagcaaacactgaaggacagagaggatatatagatataaaattacattttggacatgctgctcttgaggtacccaaggaaaatttccagaagggagatatctatatatatgtttgcagctccgaggagagatacggaattcaggtctcagtgttacgtgtgtctctgtattagaatgctttttctgacacccatactcaccccctactggaatcagtggcattctaccgtcctttataacactgatctcacttgtcattatttgctcagcatttatcttcctcactagaaggtaaagaatgtgcctgtcttcttaagttccttaagacggagcacaaagtaggcatatgcagtaaatatttactggatggttgaatgagtaaccgatttgagggccaccagtaggactgaagtcacagtaaatgacaagaaaaagagaaccaatgatggcatcatcaaggggtaaaagctgcatttaagaagatggcagaagaaaagaaaacggtaagggaaagggtcactcaatggagtgaaagaagaaaactaagtaagtactaatttgtcacctccacagggtcaaatgctgcagggaagtcaaggaagaacttaaaagggtccgtccattaagactgaacaagagttgatgtcaagctgggcaagaagactcggaggaatagtgtggatggaaaaaaggaaagaaagcggaaataatacagaacaggggagagctgaacagctttggtatcccct

SEQ ID NO: 83507 - DNA, 1268 bp, Homo sapiens
aaaagttagccaggcatgttggtgtacatctgtagtctcagctacttgggaggctaaggtggatgtgagtatcacttgagaccagggagaccaaggctgcagtgagctgtgatcacaccattgcactatacagcctgggcaacagagtgagaccctatctcaaaaaaaaaattatttcttcaaaaattaaaaattaaaaatgttttttaaaaatttccttatgggctgggtgcagtggctcatgcctgtagttccagctacttgggaggcggaggtgggaggatcacccaagcctggcaaggtcaaggctgcattgagctgtgatcttactactgtattccaacctcagtgacagagtgagaccctgtcttaaaaaaataaacataaaaaaaattccctatggtggaaggatcataaagatcataatttcctctcggatattttgattaataaatttattttaatgtgagttgcatgttttctgtttgtttaaattcttaggcattttctttatgatggagaatgtttcaagaataggattcctgtattaaaaagtaaacatttgtggggattttgtttttgtttgcttcattttacttttggtaaatgttttctgttgaaaataagctaaatgtttactgatatgagactggaaaagtaatgttataaacatcttttggagttctgtacttcgaatataatgaagcagatctattaatgcaagaaattgtttgtataaataaattgttaaaatttacaaaccacagtaaaaaaaaaagccatttccaatttttcataaaacatatatgtgtatttgcaaagaaatatctagatttgttcattaaatgttaacaccagttaattcaaggtgagattaattatttttaagtaagtgttgctttcaaaatagaaataaaacaatgaaagcaactttcgttttagttaaaaaataataataataagttggccaggcacggtggctcacacctgtaatcccagcactttgggaggcccaggtgggcagatcacttgaggtcaggaattcgggaccagcctggccaacatggtgaaatcctgtctctactaataatacaaaaattaggcgggtgtgatggcttgtgcctgtaatcccagctacttggaggctgaagcatgagaatcacttgaacccgggacacggaggttgcagtgagccgaaatcatgccactccagccactccagtccactccagcctgggagacagagtgagactctgtctcaaaaaaaa

SEQ ID NO: 83508 - DNA, 472 bp, Homo sapiens
attcaaaatgaaacacaaagagaaaaaggaatttagaacctgtgaactatgggttaacttcaggtgaccaaatagacgtgtaattggagtcccagaggagagaagtgatgggggatagaaaaaatatttgaagaaataatggctaaaatttttccaaaattaaaaataacagctgggcatggtgtctcaggcctgtaatcccagcaatttaggaggctgaggtgggtttacaccgtgttagccaggatggtctcgatctcctgacctcatgatctgcccgcctcggcctcccaaagtgctgggattacaagcatgagccaccgtgcccggccatagaattttgtctgttttctaagtagaaatacaagttcaggacttctgctcatttgaaataaaagggactgaatttatacttccacctgaaacaatttatttaaaaagacaacatatgttaataatggttggtttggta

SEQ ID NO: 83509 - DNA, 305 bp, Homo sapiens
ccagcacagatgcacagcaaatagtgctgaataaagacccagctactgctagcttaccctgctccaaacattcaccaagtcctcagcaaagagggccatccattcacctcttctaaaaacacactgagctccccagtctataccccaagatatgcttggctcccaactatactttctctctccactcccgggagtgggggagggtacaggttttaaataaaatgtgttgggtaattagagaagttgctggttggggaaagaggactgaaaacaattcaggaagataaacagacaatctctcctct

SEQ ID NO: 83510 - DNA, 356 bp, Homo sapiens
aatacacaaacaattatatttctcggtatagacatatatataactttgaacccgagttctccaactatcctttatttgggaaaatcagatatggcttctagttcaaatgattatttctcatttataaaaggaagaaatattctgaaggtaaagtacttagtcgactattaaatagagcttgatagagccagaccaaagcagtcacacaacaatgcaaaatattatcttgctccattgtgagctatggttgagtatgactggcttctgacaaaacaattcactacatacctgacctaaattactctgttgtttttaattaaatgaatgtggtatgcaaaaaagcaaaataattaagt

SEQ ID NO: 83511 - DNA, 420 bp, Homo sapiens
tttttttgagatggagtttcactcttgttgcccaggctggagtgcagtggtgcgatcttggctcactgcaagctctgtctccctggttcaagcctgccgagtagctgggattacaggtgcctgccaccacacccagctaatcttttgtatgtttagtagagatggggtttcgccatgctggccaggctggtctcaaactcccgacctcaggtgatccacccgcctcggcctcccaaagtgttgggattacaggtgtgagccaccgcgcctggcctgtgcaggcttttctttccagtgagttcttctgtctttgcctgattcgcccctttctgagatggagaccatgcgctgtccccatgggaagcatttcttcaccgtccgaggccaggctgtaccttcccttctgagttcctgtggtgc

SEQ ID NO: 83512 - DNA, 440 bp, Homo sapiens
tcttttataagggcattaatcccattcatgagggcagagcccccatggcccaatcacctcccaaagtcttcacctcgtaatgccgtcaccttggggtttaatttcccacgtgaattttggagaaacgaaaacattcaaactgcagtactagctaatgcaataagataataaacagaaataagaagcaaatagattgggaaaaaagaaataaaactgtctttgttgacagatgacatgatcatttatatagcaaatccaaaagaattaacaaaaacaccctggaactactaagtggttatagccaagttgcaggatatgagggtaatatacaaaaatctatcactttcctatttatcagcaatgaacaagtgtaatgtgaaattgaaagcatattatcatttacattagtacccccgaaatgaaatgcttaggtagaaatc

SEQ ID NO: 83513 - DNA, 712 bp, Homo sapiens
ctcaccaggtctgattttattgttttgtaagaactgggctttaaaaaaagtcagaccatatgataattttgatattaaaactcttctgaaagactaagtgaatgaactagtcatctatattcactgattaaaaacaaaataagacaaacttactccatagtatagtactttgggtttgtctaattaaaaaaaattcatttacaaataccatttctgaggaacaatagcatttctctaggatacatctacatacatgcaagtgaagaaaatagcttttgtgtttactttatgtcttgtaggagttgtatagctacataagagtattgtaatgcaagaggtacatcataaaaactgctttgttatatgttgtgtgcatgtatatttgtgcatttacatatcaacagcatactcactgttgttcagtagcatattttgtgatgaatgatgaaaccagtacaaattaaatgtgaatttgacttatgaactcttcacatccactacctcataaacattacaagctagagaatgtagggatttgaatccacaaaccacagatgtcaagattaatacattacgttttgattacttgaaactgcctgtacaattgaatttacagttgttttttaaaaaagaaaatagaactgagaagaagtgctacaacaatcatactttgtgatttaaaagaaaataaatactactagttcatgcccag

SEQ ID NO: 83514 - DNA, 965 bp, Homo sapiens
ggttacattgccatcattaatcaatctatttcacagagcccttgaacacttaaatgtttgcttatgcattcacttattcattcaacaagcatttctttagcacttaaaacctgccagagataatcagagattcattagactggcaagtgccatgttataaagataaagatcaataaatatggtaattcttagagttcatgattctaagaagcatatttttttctattttgacatctctaaaatttggacacatcatataattgtgtgtttcaattgtaattggcagtatgttttccttaatggtaaataaaataagagtgtcttacaattgatgtcttagatttgatgaaatacggtacatttctaaacaatcataaagttttaagatctcaaagcaagaaccacatgtaaggtgtcttcacatttccctaactcctagcacggaatcacactgaatacattttttgctaatcggtaaagaaacatttctctcaaaatcttatctttaggcttaagtttttgctttctgttactttagaatgtttttaaaaattagtatgtaaaatgttatctggcaatattactattcttccattggatagaatagcttaaactttattgacattttaatcctttttttattttatagttcattacttcttttcagcagttacactataccttacaattaggaattcttgggttgtatttccatttctgatttggagatggttgaagtgtatgcttgactgactaggatttagtttaagataaactgataaagtatagctagttttttgttatccatcataataggatgggtaattgtaatttgtgaatgatatctcaaccctttattagtttttttatgacaggtactaatatgtgtcaaagttatactggtttgtattttaaagcttaatgtttcctctttaggggaggtagtaataaatactgaaatggca

SEQ ID NO: 83515 - DNA, 505 bp, Homo sapiens
atggtagcatttcagaggagaaataagaaggcctggatcaaggccggccaggtaaagagaacatataatagtgatatgcaggagataaaattgtcaggataagtgggtagaggggctgtagtaaatggaggtctccatggctcccagtggctttgtagatggcaacacctttatccaagagatcaaatccagatgcaatcttagacccgaggagaataagctgtcaagtttgattctggacatcctgccatttgaggtgtcaagggatgaccttactggaaatgttcttctaggcaaatgtgtaaatgggtctggagtacagaggcaggatttggacggtaacagatatgggcagcagctgaagctgtgtgtacatgagagctctcttttgagagagtttaaaatacgacaagatgaagctctggaggtatccgtgagctgagggagctctgctaagaaggtaaaatgaaggtaaagcaaaagccagaggctaatgtgctcgaat

SEQ ID NO: 83516 - DNA, 345 bp, Homo sapiens
agacagatggaagaaagaaaggatagtcaggatttacataggcagagtcagcaaaggggaagggaaagacattctagatgaaaaaatatcataacaatgtaaaatgttaataacatgctgaagtgttcagagagtagtcagagcaccaaatgaccgacgatgaagagtttatgctgaggaatatttaagtttggaccattttggctacaagtagcaataacccggccaagctaacttaatcaaaggaggaatgtattgctgcattttagggatatcctacccaattcaagaggagggatgtagttgcctctagggacacatgaaagcagagaccagggtgtaaca

SEQ ID NO: 83517 - DNA, 232 bp, Homo sapiens
cgagattagggacacatcactaatatgaaagaaggacaaagaaacataaaaaaggatcaaacacaaatattaggtataaaatcacaatatctgaagtaaaagacatcttgaacaggctatacaacaaaatggatacagttaagaaacaaattaataaattgaaagatcagatttggggaatttccttgaaggagggaacaaaagaaagaaaaatatgtattttttaaattta

SEQ ID NO: 83518 - DNA, 665 bp, Homo sapiens
ctgttgggctcaagcgatcctcccccctcagcctcctgagtagcagggaccacaggtgatggccatcacaccgaactaagtttttattttttgcttgcatttatttatttatttatttatttatttatttatttatttatttatttatttttgagccgagattgcaccactgtactccagcctgggcaacaagagtgaaactctgtctcaaaaaagaaaagaaaagaaaagatgaaactgacacatcagagaattctctgactcatgagatggagacatctgctacagagaaagtgggctaaactgtaaataaagacaaaaaatgtgaggaaagttatttttcccttgcctttacagatgttaatgatttaccttattgtgtcttatgcaacaatattttgaatactgttatggtgcaagttaactgccacatcagtttgagaccaatcattcagagtctgaagaaaaaaaatttaaatgcagatgtgataaattaatatgtcaccaagagaactgtacttctgccttacaatagaatctctggacttactgtattgcttgtacttgtctggtatcagcaccaacttaagcacagaagctcttttatatgaaagttggccacacacccaagtggtagggaaatacttaaagtactgaataactat

SEQ ID NO: 83519 - DNA, 317 bp, Homo sapiens
ttcattgggcacgtaggtaagctgctctcatagcaattaaagttactggatacataaaacatagaacatcctttttagctacctggagatgtttagtgaaactgaaggaaattaattgaaaatgtcttgatttttaacttgctgattttttttagctggcaaaaaattgcaagtacttttttcctgaagtttaggcaaatgaataattctgtaacggcatagatgctggaagaaaaacttcagtatattgtacgtaacatataattagtctattgaccattgatggtagttcagcatagtattatatatcagtatct

SEQ ID NO: 83520 - DNA, 442 bp, Homo sapiens
cacttctgcctacttttctaggtccgtgtgagattatacaggtggaagaacttattgacttaacacaacaatgttcctggagctgtccctttgtgtctttcaaacactggggccaggacatacagttctggggtggccattatggagcctgtgtgaccaactccagggtggtcatgtgagtccatctgtcctaatcaaggactacccttctggcaagacagcctaaccatgccttccaggacctgggattattggctgggacccctcattaactaagtgcttgtacctccctggcacgctgggaactcctgggtctggtcaaaggtctttctgggcctgtcttcagggtctggaaactactagaagaaagttcttccatccgatctgcctacagctgctgctttgcactgtacaaatccatgttgttacctctcacctctgg

SEQ ID NO: 83521 - DNA, 440 bp, Homo sapiens
aattcacatcccctatttggtgagaatatgggaacatgtcattttaatcataactttaaaagttagatttggttatgctctttaagaaatatgcacaggtctctcccactggagaaagtctaaaattaaataaaaattagtattaaatcgtaattaaaaaaacaaaaagggctgggcacggtggcttatgcctgtaatcccagcactttgggatgccaaggcgggtggatcatgaggtcaggagtttgagaccagcctagccaacatcgtgaaatcctgtctctactaaagacacaaaaattagccaggcatggtggcaggtgcctgtaatcccagctactcgggagaatcgcttgaacacaggaggcagaggttgcagtgggtcgagattgcaccacagcgctccagcctgggcaatagaacaaaactctgtctcaaaa

SEQ ID NO: 83522 - DNA, 261 bp, Homo sapiens
aaaaaggccataaatccttgccctcgtggagcttaccttctaataaggagagacagagggtgagaaacaaacaaacaaaaatatgtgagttaacacagagtgttggagggtgtcaggtgctatgggagaaacgtggagcatgtcaaggagagagcaggcaagagggcattctggaaaggcctaggaagatggtgacatttgaccttcatatccaccaacccccagcacaaagcatttgccagaggcagacagaggagggca

SEQ ID NO: 83523 - DNA, 379 bp, Homo sapiens
cctagtctcatttcccttgagtcaaataaggagtttattgaataccacctgtgtgcagagcagtgtgccaagcactagagtccataccaagatatataattccatattgtgattctaaatcgtgtagtctatttgggctctcacaaattaaataacagtacaaaacagtactgtgccaagtgagcagtgaaaataggggctagagaagtcaggaggagagcagtcacgtcgtgacagacctgttaattgctggaaatgtttggtttgatgagggttagtgagcagatggtccagtatctcccaggtgtctgtttgtaatcatcccctgctcctccctcttcagtcacctcccagcccatacacacacacacacacacac

SEQ ID NO: 83524 - DNA, 350 bp, Homo sapiens
  misc_feature (163)..(163): n is a, c, g, or t
  misc_feature (329)..(329): n is a, c, g, or t
ctgtgcagaagtgaacggaaagactcatcattcttagagagtggaattaagactgcgagcaaattggccctttccatggctcccaagggcaacagcgtgctgcacctgccactgtgggtgtgcccggactgccgcaggaccgtggagaaggaggagaggcatngcggccttgaccagccagtgagccaagattttcttcttcactcctcgcttggtggctcccagccagaggccggcagtggtgggaggctcgctctgggtgcacagacgctgccttcagacaccgcatgctcgtgcgaggcctgcagtgagcgcagagaaatttcggnagaggcggaccgggaacctca

SEQ ID NO: 83525 - DNA, 529 bp, Homo sapiens
gttctgcaaaagtgctcacatagctgggcaggatggcggcgcgtgcctgcggtcccagctacttgggaagctgccaggaacccaaggctgctgtgagctatgatgctatgatcaagcctgtgaatagccactgtactccagcctggacaacatggtgagaccttgtctcaaaaaaaaaaagttctcacattgagcgattcaatttctgagtctatgcatttactttaaatacttataaagcacctacaatatagtcaggcactgcaataggtactggggacttagcatgaaaaaaacaacaaaagacctgcccctcaggtgtatgtattttggtggaagacacaaatacacaagtgtaatgtatgctcaatagtgttaaatgtcccagagaaaaataaagaagaaagagtggctgggaggttaaaactcgggatgaggaagatgctactcttttataaaatttggtcagggggctgggtatggtagggtaatcccagcactttgggaggtcgagatgggtggatcactt

SEQ ID NO: 83526 - DNA, 455 bp, Homo sapiens
ctgtagccccagttactcgagaggctgaggcaggagaatcgcttgaacttgggaggcggaagttgcagtgagccaagatcgcaccactgcactccagcctggcgacagagcgaggctccgtttaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatga

SEQ ID NO: 83527 - DNA, 3001 bp, Homo sapiens
gccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcatggtttccattttttttttaattcttcccttggattaatattttctactgaaaagaaatgaaatctcagttccactatgataaaagaaaccgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgaaaaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatga

SEQ ID NO: 83528 - DNA, 2626 bp, Homo sapiens
  misc_feature (76)..(76): n is a, c, g, or t
ctctctgacagctaaatatactatcgttaccatccctagtagctctgttagcgatcatacgacgtagacctgcggnacacagtcgagcaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcatggtttccattttttttttaattcttcccttggattaatattttctactgaaaagaaatgaaatctcagttccactatgataaaagaaaccgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgaaaaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatga

SEQ ID NO: 83529 - DNA, 3993 bp, Homo sapiens
gccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcatggtttccattttttttttaattcttcccttggattaatattttctactgaaaagaaatgaaatctcagttccactatgataaaagaaaccgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgaaaaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatgattgcatttgtaattgtttatattgaaacagtaaccatcaaggtagtttggggatagagattatggtatctctggtgttgataagtgtttctcatgatgtcctgaaacccaggatgaaataatacaggtgctgaaaagctgtcacatgtcattcagaaaccatcatatgaacagtccactagtattttagccctagaagtgaaggggaatctcttaacatgaaacttcaggaggcataatgggaatctacaattgtagaattggctgggtgcagtggctaacacctgtaatcccagcagttcgagaggccgaggcaggaggattgcttgagaccaggatttgagaccagtctgggcaacacagcaaagaccttgtctctacaaaaactaaaattagccattcatgatggtgtgcacctatagtcccagctactcggaaggctgaggtaggaggatcatgagcccaggaggtcaaggctgcagtaagcaacgattgtgccactgtactccagcctgggtgacagagaccctgtctcaaaaataaattaattttttaaaaatcgtgtactgctgggctttagtacattagttgtgcaaccagccccactgtctaattttagagctttgcaattaatccagccagtgatcaattcctcttctataaaatggtgataaggatggctaccataattgtgccctgattatattgtcagggttatgtgaggaaatgctcataagcatctcagcaaagccaggggtacagggctcacctgacataagagatatccttgggtttgtcctaatagcgagaaaccgggcctcttttgcctctttttttccctcttgctgatgtgggagaggagagaacattcaagaggtgatcagcagacatccttaattttgataaaggcagctgagcgggaaatataaggtcggttctgtgtagatagacaggtggaacccagcaatcagtttaaccagcctccaagcggtt

SEQ ID NO: 83530 - DNA, 3372 bp, Homo sapiens
gccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcatggtttccattttttttttaattcttcccttggattaatattttctactgaaaagaaatgaaatctcagttccactatgataaaagaaaccgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgaaaaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatgaaaaaaaaaaaaaaaaaaaaaaaaaaaaaaaaaaaaaaaaaaaaaagggggggggggcaaaaattcccccggggggggcccattttggggccccgtttttttgaaaaagggggggcccattaaaggagggggtgtaataaaaagcagaagaggacaagggcggcgtgtttaaaaaacacgtcgagtgagggaggaaaacgtggtagtctgggaggatctattgggggaagagcccccaacttcgggggtggggaacatattgggaaacatacccaacagagatttagcagctcagggaagattaaatttaagtggtaatgtcggaacacacggcatgtcggggtaaaatttgtcacgaatggtcgaaattcg

SEQ ID NO: 83531 - DNA, 1819 bp, Homo sapiens
gccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcatggtttccattttttttttaattcttcccttggattaatattttctactgaaaagaaatgaaatctcagttccactatgataaaagaaaccgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattata

SEQ ID NO: 83532 - DNA, 120 bp, Homo sapiens
aagttgtttgacagaagtgtaatctccccagaagtcctgctggacaggcttcacttttcctttggaggaacacagagatacagggaatatgttttaatgacatatacctaacgctgaaca

SEQ ID NO: 83533 - DNA, 671 bp, Homo sapiens
  misc_feature (663)..(665): n is a, c, g, or t
  misc_feature (668)..(671): n is a, c, g, or t
cttttcttctctttgcttatgccaacctgggttcacactcacctctttgtcctgatttttctcagaccgccacaagcatatgtgaaaagcaaacgtcactgaagtttgcttgggtttggtgggcgggggaaggctcttaaatttgcagaaatacaaacagattagaactgaatgttggacattcattctaataacctcttagatcaaagcatcccctgaggatttctcactggtcacatttctctgcagattccagtctcccaccatgctgctggtcctcagactctcttcacatctccctgctcctctgtttttccagcatcctcatcttggtccacaaagtcactcatgttctctgacaatcagacagtcacctaatctgggccccatccaggagtcccatggaagaactggcggaggtttttaatttcagtctttcctctctcatcttcacttgctcctgtgggtggaagtaagcagcacaggaacttattcctcactggtagaaaacatccccttagaagacagaagaaactagcaacggtcaattttgatttatataacaattttgacatcctcatattatttgtgagtgataatatcgaaacaaataactgaccataaatcatgaaacatttaataaaatgggaactaagcagttannnaannnn

SEQ ID NO: 83534 - DNA, 272 bp, Homo sapiens
gattagacaggtgcttgtatcagatacagttcttcacttcctttagcagatttaatatcataattgtttaattgacagcaaaataagtgcaaatatcatactgtaagaataatgagcattcagttcatttgatgacagtgtttattgaattctcaaaattaatagtttcactgctgtctatcagtatgctttatgttgccttaatttttttttcaaatgtgcagattgaatggtgctgcagtatctgttaagtttattaagttcatcttggc

SEQ ID NO: 83535 - DNA, 507 bp, Homo sapiens
taaatggcaaattataaatacattttaggtctgaactcacgaaataatacctgcccccatttttctccttccagctccacagagaaccgaaataaacttttgtaaattacacaggcaaaaaaaaaaaatctgcaacagtgaattcctatcagttagcattcttgtaaccatggggaaatcaggctttcttctttttttttgagacagagtcttgctctgttgcccaggctagagtgcagtggcacgatctcggcttactgcaacctctgcctcccaggttcaagtgattctcctgcgtcagcctgccgagtagctgggattataggcacccgccactgcgcccggctaatttttgtatttttagtagagacggggtttcatcatcttgaccaggctgttttcgaacttttgagctcgtgatccacccgcctcggcctcccaaagtgctgggatcataggcgtgagctatcacgcctggccaggctttcttctttgaaccctctgaag

SEQ ID NO: 83536 - DNA, 844 bp, Homo sapiens
catcaaaaaaaaaaggagctaactagatgctgtcaataagagactcactttagatctagagacacaggttcaatgtaaagggatggaaaaacatattccctgtggaaatcccaatgagggtgctatggttttgcatgtggtttgtccccaccaaaactcatgtctaaatttaatgcagatgtaatggttgtgggagcctgggccttaagagataattaagatggattaatgtgctttcccatgagactgggttagtctgagacgtacttgcaaaagcatgttgtcgttaagtgggtcatcctcctttgtcctgtctcttttatatacacttctttccccttctacttttccaccctattatgaagcaccgtgaagccctcaccagatgccaccaccatgcccttgtaattcccagcttccagaactgtaagcccagtaaatttccttataaattacccagtcttaggtattctgttacagctacagaaaagactaagatttttgcagaaataggaaaatccatcctaaaataaggaatctcaagggattctgaatagccaacaatcttggtaaagaataatattggaggtctcacatgtcctgatttcaaaacttaaactacaaagctacagtaatcaaaactggtactggcataaagacacatagacagattagagagcccagaaatccttgtaattcaatagcaaaacaattaaaaatgggcaaaggacttgaataggcatttctccaaagaagatacacaaacatccaataaacacatgacaagatgctcaatatcactagtcattagggaaatgaaaatcaaaactataataccatgtcg

SEQ ID NO: 83537 - DNA, 367 bp, Homo sapiens
caatctagtgtccagcaaacgcaatctttagaaaacactagtcaaatttggtctcctaatcccccttatggctacccattatcctcagaataaagccaaatttagtaacaagacccgttagatccttcatgatttacctccagcctaccttctcagtctcatttctcaacacacaccagcttgactaaatcagcttcctcaatatgtctctctctccacaaccttattcatattgtcttctctgcctggtatactcctctcttgaccccttctatcttcagttgattaactcccactgattctttacgtctcagtttagatgtcactttccccagaaagtcttgactcatccaggttaggtgctttt

SEQ ID NO: 83538 - DNA, 408 bp, Homo sapiens
cctgtaggaaagcagggcagggctttgtatccatactaaggattttgtacgtgggaagccattaaatcgtgtgttcttttcattatttattaaggtagagtacatataacataaaattaatcctattaagcattttattttattttattttatttttattttattttattttttgagacagagtcttgctctgtcacccaggctggagtgcagtggcgccatctcggctcactgcaagctccacctcccaggttcaagccattctcctgcctcagcctcccgagtagctgggtctacaggcgcctgccaccacacctggctaattttttgtatttttagtagagacggggtttcaccatgttagccaggatggtctcgatctcctgacctcgtgatccacccatctca

SEQ ID NO: 83539 - DNA, 734 bp, Homo sapiens
gttttttttatgtttttgagacagggtcttgctctgtcgcccaggctgcagtgcagtggcgaggtcacgactcactgcaacctcggcctcccaggcttaggcaatcctcccacctcagcctgttgggtagctgggacctcaggcatgtgccaccatgcccagctaatttttgtattttgtgtgtctttttgttttttcactgtgagtatacgttagtcatttttcttaacaattgaaactgggaactctggggattcagaattaacagccttggctgtgagcttcttatcgataccagaaaaagtttggaccttgcgttccacgttgttctgctgggctttgtccgaatgaacccttgtgagctgctgtgtccatttcacgcggattctcctgcccacaatttcacctgggaagaccgagtcctcgaggattgcgacgtgcgcagctgtcggagcgtggatcctgggacgcttttgcttattttttgtacaccttttttgagttggtttaggcagaattttcctctaagcaatagacgacatacttaccagtgaactttttctccaattcacgtactagccagacttggatgttctggaattatttcagtggcagaagaagaacaaagattatgataacttccttttttttttctttctttctttctttcttttttttttttgagacagagtgtcgccttgtcgcccaggctggagttcagtggctcagtattg

SEQ ID NO: 83540 - DNA, 406 bp, Homo sapiens
acttttgtattattagtagagacagggtttcacccatgattagccaggctggtctcaaactcctgcccacaatttcacctgggaagaccgagtcctcgaggattgcgacgtgcgcagctgtcggagcgtggatcctgggacgcttttgcttattttttgtacaccttttttgagttggtttaggcagaattttcctctaagcaatagacgacatacttaccagtgaactttttctccaattcacgtactagccagacttggatgttctggaattatttcagtggcagaagaagaacaaagattatgataacttccttttttttttctttctttctttctttcttttttttttttgagacagagtgtcgccttgtcgcccaggctggagttcagtggctcagtattg

SEQ ID NO: 83541 - DNA, 478 bp, Homo sapiens
gctcctatagtagggaggcttgctgccatggtgagtaccgccagcatggccaccatcaggttactagttgtttttagtttgttctgtgttttcaagttgtcctttgccatctgcgccaacttcttgatttgtccctatgttggagaatttgcctgatgactattctcagttttctccttcatctctgagaggtttatttgtgccatcactcataccgggatttttggctcttcccagagtcctctcttcctgctgtagttcatgatagatcttcagatgtttggtgggcacgcatacaggcacatgattgtcacctggagagacacaagcaaatcctcttccccatgtaattatccgccctttgagtagttaaagggccagggaggttagtatgtgcttttatatgagtaatataaaaagggggaatgtctttgttgtactgcttgctgtaaagaatgaaataaaagattaagttggt

SEQ ID NO: 83542 - DNA, 302 bp, Homo sapiens
tccaaaaacatcttctaacccgcttttggaaataatgggattccttgatcacgggacaacgaatcaccctgaagtttttctccagtttactcagtcacataagccaccagaggctaaccacactgacaacaaaagcaagtcccaggattccgggggctaataccatgctaggcattacttgggaagttatgagttggtatacatctgtgaatttggtgggaggagaaaactaacagtaaatttatcaaagccagtggaacgttcagcgttataaaattacaaggatctgcttctcggcgact

SEQ ID NO: 83543 - DNA, 454 bp, Homo sapiens
gagccaccatccacataactaattattatgtaaaacgaaaccatgaaaagaattgatgcttctccatggcagtagatgccccaggggaacagagttcccattcctggtttcccccgtttgcagcctccacacttcagaagaactagcaagttgcaattggcacttgaaaaagtgttacaaaacactgacaagtattagagaaacgttgattaatgtaaacagcctgcctcaaggaatgatacctttcttaagcagttttcaattcgcatttctatgtgcaggtaaatgcagtgtttgaagagatgtgatttttgcctttgctggagagaagagaggattatcatatttacatcttaactttctgaaaatttgaaaaaagaattgacagattaaaagtcaataggcccaaaaaagaaggaaattctgacacatgctacaacatggatgaaccttg

SEQ ID NO: 83544 - DNA, 317 bp, Homo sapiens
cactcctgcagtaatggtactagttgattcatgagagctctgcctctaagagatcccacctcccaataccatcacaatgacaattgaaattcaacatgagttttggtggcgacaaacattcaaactatagcaatatattgaattatcatatcaaaaatatgcctttgctctcattccttcaataagttggacagggcagtagaaatgaattaaaatttagaaaatccttcttacctgaatgtaaaatattgtaaaatttaagtttagcaggatttggcccttgtctctaatgctataacagatttagagattgttcc

SEQ ID NO: 83545 - DNA, 542 bp, Homo sapiens
agcgattctcccgcctcagcctcccgagtaggtggaattacaggtgcctgccaccacgcccagctaattttttgtacttttagtagagacggggtttcagcaggttggccaggctgctctcaaactcctgacctcaggtgatctccatgcctcggcctcccaaattgctaagattacaggcatcagccattgcacctggcataagttcgtattgttttcagtatcacaaccacatacatgttcaattgcacatatactatgttctctacaaatgtgcagtttggacctgcctcatcttggtactctacaacaagagcattgcattgtcacacatgtagacaatgaattgactcagaatcacaaatacttgtactggggacctgtagggagaagtcaagccctaggaagagtaccaggtcatcatctgggaaaggaaatattaggagtatttggggtgtgaatagtactgtattgaattccaattcatttcaaaatatatttcacagattatcacaaaccaggaaataagttgtgtgtatttt

SEQ ID NO: 83546 - DNA, 426 bp, Homo sapiens
tggttgttgttgttgtttgttgttgtagagacagggttttgctatattgcggttttgctatattgcctaggctggtcttgtcttgaacccctaggcgaaaatgatcctcccactttggcctcccaaagtgttgggaaaacaagcatgagccactgtgcccaggctggagagagctttctaatgccacacatcccagcacatcactctgctaatgaagtccaggtagggctcaccattgccctcaggataaatgttagcctggcaccatgttcttttccatgtgcagtctctggctgcatcttctttttctaccctactctctaacacatccactgccacactgaattagttttctgaaatgccattccctttttgggcctcttggcctttccactgggcgacattctttgtcctgtcacctctgtt

SEQ ID NO: 83547 - DNA, 358 bp, Homo sapiens
tatttttgtttgagagtctgacgcagtataaagttccaagctgaaaaaccttttcccccctgattttgtgtttatttttccattagtttgtagaatccagtgttgctattgagaagttcaatgtcattttgtttcattttttttcaactttaattttagataagggggtacatgtgcagatttgtcatatgggaatattacatgatgctgaggcttaaggtacagatcctgtcatcctggtagtgagcatagtacccaatagttgtttttttttttatcctccccacctccctgcaccctctagtagtccacaatatctgttgttcccatattaatgtccatgtgtgctcaatgctta

SEQ ID NO: 83548 - DNA, 628 bp, Homo sapiens
atgccagactaattttttaaaattaaattatatatttttgtatattttaattttctttttatagagaaagggtcttgctatgtttctcaggctggtctcgaactcctggtctcaagcaatccacctgcctcagccccccaaagtgctgggattacaggcctgagctaccatgtctagaccacagccggctaattttaattttttttgtatagacagggtttctccctctgttgcccagtctggtctccaacttctgggctcaagcagtcttcctgccttgaccttctaaagtgttggaattacaggcatgagccactgagtcctgcccatagagtgtacttacgcaaacctagatagtatagcctactgcacacctaggctatatgatacagcctactgctcctacgctacaaatctctacagcatgttactgtactgtatactgtaggcaattgtaacacaatggttggtatttttgtatctaaacatagaaagggtacactaaaaatggtacaataaaaatacaatattgtaatctgatggaaccactgtcttatatgcagtctgttgttgactaaagatcatgtgacatgtgactgtatttgctcaatgtattgcatggagaggg

SEQ ID NO: 83549 - DNA, 588 bp, Homo sapiens
tgaagcattcttcaacaattgagggcagaagctgaggatggggtggaaactccaggcttaattccaaaaggatttcttctgaatcttcctgtgggaggggaaaaaaaatggtttatttgtttgtctcaaaagttaagagcatgtatatggaaagagcttatgactcatataatcctcatttttacttactgggggagggactctgggtcctgggtctgtagtttagatgtggctcctcagaatggggtatatgagagaggagggtgtatccctagatgttattagcctaaggggtgcctggagtttggaaggtaggtgagtctcacggaaataagaacaagtaggcccagccctcagcttagctgcatggtctgtgggaagtgggattctttctaacattggatagattgcggtgtttgcaaacaccgcaatctacagtatttcgaggaatgattggacatagcatggttaacagtaaaatacttctcttaaagaaaccaagagtctggtgggagctagaaggcccacaagtacctctgcgtactgactgccttgctatcgtcaataatcttgtgtgcctgtaaggcg

SEQ ID NO: 83550 - DNA, 720 bp, Homo sapiens
tgatgttcctgccaaagtgaggctggaaagctaggaagatctgtaagacgtgtgccagcacaaagtgactacaattcaaaagttccaaaaaccttgcttgaaacaattgcaaatagctcatcattttaaaccagtgaacccaaggctgagtgtttcatcaatttacagaaaaccaagaagagaaatctgacagctatcccagtgtatgacttaccatggagatcttcaaatagaatcactttggtttgggtctcattttcatattataacacaaatttgtgtatgtgggttaagattcatatttgataggaactgctgggaattcttgcagttatatcctcaaaagacaaaataagcataaccaacagaattgtgaagcaataaagttgattatggatgaaaactgggctgaacagtcataggacatgacttgttcctttgacctaaaatgtgcttttctttccttatctacccagtgtaatggtactactctttcaaccatcttgaattcactcacacttattcgtcaaatcctgctcagctattcccactacccacaaagtgtacctttttcgtattccttactttttatacattagctcattttcccccaaacaatgcaataaagtaaaaaatattactctattttatagaaacttgcagctcagaaaggataagaaacttgcaagttgatccaaaataaatttctaaaaagcaaaa

SEQ ID NO: 83551 - DNA, 617 bp, Homo sapiens
taagaactctgccttaaagagttacaactctgccttcaagagttagtgagagaacaatcctattgttttaaattattgattccagaccataaggaactgtgaagggcattcataggataaatagctctgctgaagtccagaaagggttttagcttagtggtcagggaaagctctgagactttgaaggatgagtaaacctagacaggaggaaagcatcgtagatggggaaaagagcagaggactggaggcaggaatcctcctctgagtttgggaggaaagacagccattggactagaaatgaggaaacacttgaaactatggtaactatgagatgggaacaagaggagctcaccttcttatggactgggtatagttttagggaaattcatctcaaagcaaggtcacttattgttggattaggccacaaaattaaatattgcctatcttatttgtgcagagcttttttgaaaaacagctttctttcagaatcactttattatagggaggagtcagtatttttctcctcaaactgagctatggacattaaaagtatagtctgaatgaagtatatagagttatgacagtttcagaacccaggtatttttcttatagtccca

SEQ ID NO: 83552 - DNA, 451 bp, Homo sapiens
tgtgacagtcttgctctagaatgcagtggcgggatcctggctcactgcaacctcaccctcctgggttcaaatggttctcctatctcagcctcctgagtagctggtgcatgccaccacacttcattttgctgtatttttagtagagtcagggtttcaccatgttggccaggctggtcttgaactcctgacttcaagtgatctgcctgcctcagcctcccaaagtgctgggattgcaggtatgaaccaccgtgcctggccaataggtttttggtcaggtgtgaggtttgggtgatggggttggggatgctagagctgcaagctcctgggagcaggctgagcttccaagagggagcgagtccttgggttccttctgccctggggaatttcctgagcagtgggaggagagctggcaactaggtaaatctcccagagtttgaggaaatgagatgct

SEQ ID NO: 83553 - DNA, 470 bp, Homo sapiens
cacagagtggtctcaaattcatgcatctgacaaacattactggttattcaatttgtgtatgactgaaacacttccatttgttcatagttcaccctcttccaaagaataggcctctttaggaaaagagggtgtatgaatagcacacgtaaatactcaagtaggtgacaggggcagttatttaaagtggtttagagactagagtcaccagcaaggtggcaagggggacctattgtggccaaccgtggtggctcacacctgtaatcccagcacttttgggaagccaaggtgggcagatcacttgagtccagaagttcaagaccagcctggctaatatggcaaaaccctgtctctactaaaaaatacaaaaagtccgggcgtggtggctcacacctgtaatctcagcactttgggaggccgaggcaggtggatcacctgaggtcaggagttcgagagcagcctggcaaacatgg

SEQ ID NO: 83554 - DNA, 330 bp, Homo sapiens
tttttttttggagacggagtttcgctcttgttgcccaggctggagtgcaacagtctgatctcggctcactgcaacttccacctcccgggttcaaatgattttcctgcctcagcttcccgagtagctggaattacaggcatccgccaccaggcctggctaatttttgtatttttattagagacagggtttcaccatgttggccagggtagtcttgaactcctgacctcaggtgatccactggcctcagcctcccagagtgctgagattacaggtctgagccacactgcgcactgcaatcttagtattttctaaggcagaattcaaaggggg

SEQ ID NO: 83555 - DNA, 451 bp, Homo sapiens
ctggtggtggcctgagaggagggagcaggttgagtcgttggcttcttctaaggctccctgaggcctagtgggaatgcggaaatgagctgctgttgcttcccagggaacaaatcggatggaacttgggaagagactgtcagctaccaagtaaggagatttctggttctggctgcaggttctggctgatgagcaggccttatcggcacaccagtgctgccaccctatggcagtcctgggcattaccaagcctgcagtcacttccctgggctaaaccaaacactagtgctgacagaggtcaggtgacaaatgagccaccacgctggcagaaagtatagacctgccgaaagggggcagtggtgactcaccttccaatctgctgctcatccagtggtaccagatttttgaatttttctaaaagatgttctaagagctccagagggggtaaaaaaaa

SEQ ID NO: 83556 - DNA, 804 bp, Homo sapiens
gatacaatggtgtcgttcgggaaacgcagccctaacgttggtcctaagctgacaaattggtctgtggacgccaaacttccgtgctaggactttctgcgtgtggaccgggggcctagtcctgcgtgggtccaacacagacaggagaaagctgcctgcttttgtgcctcccggaggtcctggtagaagcgaaacggggacaggagctgcagcgtcccaagcccagtgaggcgaagctactggagacagctctgccgggtccaaagttgggctcaccggctggaacttgaaaccggagcacgccggactcctgctgaagccatcatctctctctcctggccccgggcgccttggccggcgggcacaactggtttcggggccaaggtggtctggaagcctgactgtggcgtctggcctgggctcccgcgagcggaaaaggttcccctcctgtgagagggaaactatggaagttcctacgcccggagccagaactcctgctgctcccgcccgacccaaggtctagcttggcggcctcccacctgtgcttctgagggttctgcttccaagaggctgctggtgcccgggacaccagcagtttcgccatgggtgtttcgccatgggagtttcgccatgggtgactttggcctgagatgcgctccatggagcagattctggagttgctggtgttggaggagttcctgactatcctgtcccaggacatccacagcagggtgcagaagctgcaacgggcgagctgtgaagaagctgtaactcttttaaagtatatgtatgacttttaaaagagag

SEQ ID NO: 83557 - DNA, 526 bp, Homo sapiens
tgtagtggagagaatgatgttactcccaatatcccagggggtgtaaaccacccctgtttgtaaacaggggtgtatcacccctgtgatattgttccaaatggcctgtgaaagagtcaatatgactcccattatcgcagggggtgttcagccctgatgatattgttttctaacatccagggaaggagagtatgctattactcccaatattgcaggggttgtacacctttttgtgttattgggcccaatatccaggaaaatagaggatgagagtactcccaatatggaaataattgtacagcacccctgtgatattcttcctcatatccagaaaggaaatgaatgatattacttccaacagtgtaggaaatgtatacccgtgctgtgatatctttcccaatatccagttggggagaggatcatattacttccaatatcgcagggtgtgtacaccccctctgtgatctcgttgctaacatccaggtttggggaggatgacattactgccaatatcgcaggaggagtccac

SEQ ID NO: 83558 - DNA, 380 bp, Homo sapiens
caaacaccgcaatctcaagtatttggagatttctcaaatttcttttgattgtagattttaattctttgtgatcagcaaacatattttatattatttcaatccttctaaatttgagacttgttttgtgacattgcaaatggtctaacctggaccttaaaaagaatgtgtattctgctgttgttggatgaagttttctatagatgtcagttaagtcagtatggttaattatactgtctagtgtttatacccttgctgatgttttgtctggttattctgtcaattatttagagtggagttttgaagtcttcaattattgatgaattgtctctctcagttctgtttcatttgttttggtgctctgttgttaggttgcatgtagg

SEQ ID NO: 83559 - DNA, 331 bp, Homo sapiens
atccagaggcagaggttgcaatgagccaagatcggaccactgcactccaactccagcctgggtgacagagtgagactcttgtctcaaaaaacaaaaacaaacaaacaaacagaaaaaataaccctggctatagttgagagactctttggagtcaggtgtggactaaatgttgtattctcttacgatgtttaatgtggttttttgtaagactaaagactccagaattctgttacagagttgtttgctgatttgtttcttttgtgtaagtgcccttttcatttctagatcatggttactctaacatcgttcctcaaatatatgcatttcatgg

SEQ ID NO: 83560 - DNA, 363 bp, Homo sapiens
agccaaacctctttctaaaactaccaaaccatcttttgatggcattaagctctctagcgttagatcctcaccttccttttgctttaagttgtcatataatgacttcactttttctcacatcatattagagtctacatgtactcctttcttatagcaaccctgcacataaaaggtgaattttcaatatgagataaaaagttattttgcaaaaagtgcaagattttcacacctcctggtatagcttcaccaatttcctttattttattttattttttttttacaatagtccttacactgactattgaaatagtgggcaaccataggtacagacctcaatctgtggaacatatcaagcaattcaga

SEQ ID NO: 83561 - DNA, 811 bp, Homo sapiens
cagaggcaagattagaactcagtgctgtctgactccaaagctcttgtccttttcattctgcttgacacttccctaaggagtgccactcaagccagcttctcttgaaactgaaatgagcgtcgcagacagcagagtttcaaacatgtgtggctttggtacccctaaggaaggcaggcactgtgcaattcaacacggtccctgcagctcctgaatgcaggacccttcacccaggacccttcactccttgatgttattttcttggcacagaggcattggagtttgcagcctctgtgagtgaagcaacctgaatgtataagggcaacttcttacgcagtctcttctttcagactgctttgaactgcgtattgactatttgcatgcttcatatgagtgactcacagccactatgatctccacacatcccaaatggaacatttttttctttccctccaaatatgttcctctgtccttgttccctagctaatgactggcattgtccttgaaactcctcccctccccagaaacaatcccaagacttactgattttaccttcccaggatatctaccattcctctcccctccttcctacccccatcattcaaccctcttcgtctccctcttggactagcagttgccttatctctggtcttgttccattcaatgtatcctcctgggtctttcctgagtcagcattcaaaatgcccatttgatccggtcactctgggctcagcattcctcagtgggtcctgtactcgttatttattgtggcagaacaaattgctccacaacttaacaagttaaaacaagaaat

SEQ ID NO: 83562 - DNA, 644 bp, Homo sapiens
gtcacactgagggaactcctctagcaatcaatgtatgataggaatgggtggcatgtccccatctggtagctctgtctaggtgtggggtgtgctctgcattcttccatggctccccgggtcccctaaaggttggttttagaggacagggtggataatgaattggcttcagacttcgttctggtcttgatccaacaaggaaagtagagattctgactgtgagcagtgaactaggaatcagaggcctgaactggagacttagactggttacttaactatatgtgtttatataggtcttcccctttgctaagccttagtttctccatttgtaaaaatggctatcagtagcaagcagggacattgccactaaaaccacagagacaatgtatcgtaaagctcactgcaaacggtagtaatggctgggggaatctaggatggaatcctcttcctaaatctaggtcaatctctccgcctttagttttcttcccccatcctttgcccatctgggggatggaggaactaggcagggctattgccccggttactgcagaattcccctaatgcaggttgtagctgttaccagagcacctgtggtcacagagtacagatctctccaccaggcatttcttcctctggggccccatact

SEQ ID NO: 83563 - DNA, 879 bp, Homo sapiens
atgaaagttattggtttatcatgcattcatctttatgaaaagaaaggattcggccttgcttcttccttgttacgaaagtatggccagggctgggcacggtggctcacacctgtaatcccagcgctttgggaggctgaggagggtgggtcacctgaggtcaggagtttgagaccagcctggccaatatggtgaaaccccatctctactaaaaatataaaaattggctgagtgtggtggcgcatgcctgtaatcccagctactcaggaggctgaggcaggagaatcacttgaacctgggaaggtgaggttgcagtgagccaagatcaggccattgcacttccaacctgggcgacagaacaagaaggctctgtctccaaaaaaaaaagaaagaaaaaaagttgggccagtaaaagacttagaagctgacttgccttagaattaaagttaaccagcagattttgtgtattcattcaataatcaagtctagttaaattgtttgaagccattttaatgtttaaaaaaatactaaaagaggccattgaatagtcatggaaaaagaaagcaaattattgtttttctttaagtatcagttcatctgatagatgtgggttaccacaaagcattggtggctcaccaaaaattgcctgttggtagcctgtgtttgcaaactgatacctctctatttcatggagtgatatcaattaggttatacttaaatacttcaaatgcttttggttgtctattggtttgggttttaaattagtacacgttaattgttgaattgggtagccacattttgtttgttttatgtatatttaaacaatgtgaccaaaaatactttttccatttgcggcagcaatgtgaataatggaacattgtg

SEQ ID NO: 83564 - DNA, 343 bp, Homo sapiens
gtttgagcaggatattgaaattattatacttatagaaaatatttgcataaaatatcaaatttgtctctagtattcatttgattccatcagaaattgatggaaaaaatgggaaaacatcaacatcagtgacatggaaaaagtctggacaatgaggcatacaatagctctatccaaaactattgtggattttggggtaagaccagttcaagggttcttcctggacagaataaacactgttgtggtaaacactgtgatagttaaggaggaaaatgcatatgtatttttaggttcacagccacacttcctcatatacattatgactgaacactgtttatgcacagtt

SEQ ID NO: 83565 - DNA, 834 bp, Homo sapiens
aaaatgcccacatttctggcacagttgaaatagcgagacttgagtttagacaccagtggtctccttattatgaattactgtcctgctatttattagtctttctcaatagattgacatagttggccatttttctctgtaaactctttcactcctacctgttcccaccaacacatgtatagacatgcataccccagattgactcatactcgttttggagatgttttgccatacaaataaaatgtctaagccctgtggcatatggtttatagatctcactcaaatattttgattggccctatgccatagctctagctaggggtgccaaagtgctaaatctattggttgtgtttcagtccttaccttatttgaattcttagtaatatttgatgtcaatgaccacaccctccttgagatactgttctccattggtttctatgctataacagcctctctgttttcttttcccttgcctctcagtcgatttcttctctactggtatagtctctacttggccagtaaatatcaacattttccagagtctaggtcctcttctcttctaattctgcctactttccagctgttgccttcattccacatctttggtcagtaggagcctcttcaggttggtccctgaatcctattaatatgattctggtagtctctgagagcttccttgttgtctattttaagatactctgaggttgtctgtacattttctgccctaaatagggaataagccatttctccaaaaagtcttcatttcttttagttggaaatggtatttcaagatcgtaatttgggccctagaggtgcttactgtgacaggatttgtca

SEQ ID NO: 83566 - DNA, 323 bp, Homo sapiens
  misc_feature (100)..(100): n is a, c, g, or t
  misc_feature (137)..(137): n is a, c, g, or t
  misc_feature (144)..(144): n is a, c, g, or t
  misc_feature (161)..(161): n is a, c, g, or t
  misc_feature (164)..(164): n is a, c, g, or t
  misc_feature (298)..(298): n is a, c, g, or t
tccaccttcatgttgctgtttattaatctgattaatctgtttgtttgtttgttttcaaagtagagtaaaaataaaatcaacattcctagtctcacgaggnaagtgctcaaggtaaaaaaagagtcctggagaatcgnccacggntgcgggaagcaggaacnccngatttttctattattaggagagatggggtttcaccatgttgtccaggctggttttgaactccttacctcaggtgatccgcccgccttggcctcccaaagtgctaagattacagatgtgagctactgtgcctggnctgatgaacagaatttaattactga

SEQ ID NO: 83567 - DNA, 387 bp, Homo sapiens
cataaaatatttggactccgtgaaaattctgtttgtctcaacatagcccatctggtacttttcatcaaattgtcaataaggatttgattacaattggtggcaccactgccatttgattcatggcagacttttatcatcctctttatttctagagtttacaataagacaggtaatcgatcagtgaattcttttaccattcacaaaacccgcatatctgaataaaatatactaacatccccaactttttattttattttcatgttttatccagattgtgggttttggagtctcaaaatggcaagtcctaatttggtgttcattggaaatttataagtaccttctctcttctgcttatcctaaaacttcccttcatccagcacacccagc

SEQ ID NO: 83568 - DNA, 364 bp, Homo sapiens
  misc_feature (248)..(248): n is a, c, g, or t
  misc_feature (361)..(362): n is a, c, g, or t
tacatgggtgatttcatgtaatctttacagatgttcatcattataactttatatggctgaacaggtctgtgttttgttttttccttttctttttaattagttcctgtaagcagaatgtctgtgtttttgtattgcttcactggccaagagatttctccctacattaaggagcaattttttgttgtttacttttaccctttcctagtgttgacttaaacaatgaatgttcaatgtaggtgagttcaaantctagtttgtttatattgatcacttttagttactcaataactttaaaggttggttgcaaaactattttgttttttgcagtctctgaaaagaggattctgagatgttaaattannaa

SEQ ID NO: 83569 - DNA, 828 bp, Homo sapiens
aaaaagaatagttaagtcaggaatggtcctgcctatagaagagctttgagagaggtgggcccacgggtgcccctctcacccatttgtgtactctgtgagtttaccagctctgccctggcctctttcggtaccaggaactggcaaccttcatctcactcctgagggcccaggtctctgccttcattgttgctttttctggtgggggcaaggggagctggtatggatggaatgacaagaattagtccaaatggaaccccttgaaggataatgagaaaccacaaggcctgcctctgactggggctgacacggaggtgcattagcccaggctggaggtagcccacccaaatgccctttctgattctaattgatttctttcaacagaatttgccaaaattcagacatgcacttctaaggggaaggtgattttccagttcaaaaaaatgggcaggagtggggaacaaaacaattaacgtaagagctacaaaggagggaaaaggaaccaagaagtagaaggagtcccatcaggagggaagatggtgggcctcagggaggatggggatcaagggacaggccaggagccaggagtggggaagggagggatgaaaggggacacaagtccctgtctctgaagtttctttaaaatctgagttccctcccctctctttgacattcctgaaagattaccagccagcaatagcccagggctcccccaaaagaattggttcagattgtaattatcagttaggcaatgtttttaaaacttagtaatgagaaactgtgaaaagagccaagtgttacattgagcttggggtgggagatggggaacag

SEQ ID NO: 83570 - DNA, 759 bp, Homo sapiens
ttgctagtaatatttttcactcataagtgtatatgtacttctgtgttatatgttctaaatgtttaaggagttctaatataattcattagttgatatagtatatgtttgattgaagtactgttttaatttatatgaagaccttattttatagtttcagggatataaaaggaatgcttagagtatttgatttttttttcctaattgactcttagaaaactgggtacttaacctggaacctttattttagatcaccaacttgaattttatattgtttatttcagataaaaaattagatgtgatgtttggcatgtgtaaaatcagttcacattggggccattaattgtacattctgtcacattgtaacagtagataagaaagtgattatcagaactggtctattccttgttaggattgttactttggatttagtgtatgatgtaaaatgggagaactgatctcattttatctcaataaacccagaaagtgtaaggaagtctgttttgtttgttgttgggtttttttaatttttttgagctgatgtagattcttctttccaaaccctttcctgacacatttaaagtgtgaaatgccgaggctccccactgaaggattaaggtatatgaatcaaggagattgcagttctctctggcagacttcattttcagagattgtaactgttttgtgtgtgttgaagagtgatatatttgcatccaaaaaataaatgcatccaccctggaaactacttgtctgaaataaata

SEQ ID NO: 83571 - DNA, 609 bp, Homo sapiens
gttggtgagcttgtaattatgtggttctcaacaccttaaatcctaagcctagtctggctgatcttttctctttttgagacggagtcttgttctgtcatcaggctggagtacagtggcacaatcttggctcactgcaacctccacctctaggtttaagcgattctcctgcctcggccaccttagtagctgggagtacaggtgcgtgccaccacacccagctaatttttgtatttttaatagagatggggttgcactgtgttagccaggatggtcttgatctcttgaccttgtgatccgcccgcctcagcctcccaaagtgctgggattacaggtgtgagccaccgcacctggcctctctggcttttgttttctaatgttttgttagatgttctttggcttgctttgtgaaatagtcatgtagttgatagtgactgctgccccgaaacactccagatcatcctggccagctatcagggcccaggggaagcagacagtaggggtcgggagtaggccagagtggcacatcaggaatcctgcagtgctgtggaagtcatctcctgcttgggactaactctttgcagaggacttgataagagactactcaaaaaa

SEQ ID NO: 83572 - DNA, 419 bp, Homo sapiens
aaactagcttggcgtggtggcacgcacctgtagtcccagctactcgggaggctgaggcaagagaatcacttgaacctgggaagtggaggttgcagtgagccaagatcgtgccactggactccagcctggcgacagagcgagactctgtctcaaaaatcaatcaatccaccaggtagtccaacctgactcctctgctcccactgcttggcccaggtcaccatcatctatccactgggtaactccaaaaacctcctaacaatgtcaaccggagtctacccttgcctttctctacatctattcctaacgttgcagccaaaatgcttctgtcaaactgtaaagcagattgtcatttctttgctcaaaccctcataatggctcttcacttgccataaagtaaaacctgaaatccttataatggg

SEQ ID NO: 83573 - DNA, 583 bp, Homo sapiens
ttttctttcctttttttttgaagcggagtctcgctctatttcccaggctggtgtgcagtggtgcgatctcggctcactgcaacctctgcctcctgagttcaagggattctcctgctttagcctcccgctggccgtcatttttaatcagggttgtgattttcaacctattgaagtttgagaattgctgccttagagtcttctgaaaccaatcaattgatcatttattggctgtcccagtcattttcactagccaaataaaaagtgagggctggctaagtactacattgggataatattttcttattttgaatgagaaattggactgcccttatgttccagtgagtttttgaggcctttattttcccattcttatgtgaagacagccagatacttttgcaaagcttgagaaaaagcatttgtttatggaagagtagcttggacaataaggtgcttagactttggggtcagaggcaataacagtagttagtaataatagctgcttatgcttattgaattctcttgagggatccagtgttaaatgctttttgtgaattattattactattttgagacagcatatcac

SEQ ID NO: 83574 - DNA, 1168 bp, Homo sapiens
ggctgaggaaggtggggctggttgggagagactgccccaggtgtctcggcttcctggaagttatttagggtctcttctgaggagctgcgttcgggctcccctaagtcagtagccctggaaagtgacacatcaaggatctccgaagaagagagatcttccgtgtgagattcatccagatcatcatagctctcagtgtcctctgctatactgttgttagagctgatactagcggagatctgagcaggagtaacgctagttatctggaagccacttttctttttcatttgagttccgcctggcgcaagaggctgtgcctgcagctgagcctgcgaaaggaggttcaggctttgtggaggcggaggctgtggtcccgacgtagaagatgctgcagggggcggcggctgaagcagcgacggaggcggaaaatcctcggaagatgtggcattactaccgacgccggtacctgctgcattgagagcagaggcgctgccactaccgctgccccttcgagggaacattgccgggtgcgccatcttcctagcgctaatgtctgcagcggcggcggccgcggcggtggactcaggcggctggtgcattgtgttgggtaccgggggcgcggaggagacgagtgcaatttccttctgcaccgtaatctttgtattggagacgccggagaggaaaacgggacctgacgctccgcctggcgcgattcctccttctcctcctcctcagccaaaggcgccggtcgctcctgccttcgagagcgagcccctgggctcgcggcggctgctcggtgaggaaacgctggccgcggctggggccggggcgacgcggctgcgagcggggcggcggcgaggcgcccggtacggtgagcccagcaacgaggcgcgggcgggcgcgcagagacgccgggtcctcgcggagcacggccggggcgcggcggcggcggtggcagcgggagcccagggaccgctccatcactggcagccatggagcccgagcattttcctccctcagggcaggcgcctcgactcggcacacgtcctcggggaggaaggggccggcacccgagcctctccggagggcggcgggacgtgcgctagggcggagggtgcgaccctctcttatcctcttcctccgcagccggctcttcctcaccccgctgctc

SEQ ID NO: 83575 - DNA, 1588 bp, Homo sapiens
ggctgaggaaggtggggctggttgggagagactgccccaggtgtctcggcttcctggaagttatttagggtctcttctgaggagctgcgttcgggctcccctaagtcagtagccctggaaagtgacacatcaaggatctccgaagaagagagatcttccgtgtgagattcatccagatcatcatagctctcagtgtcctctgctatactgttgttagagctgatactagcggagatctgagcaggagtaacgctagttatctggaagccacttttctttttcatttgagttccgcctggcgcaagaggctgtgcctgcagctgagcctgcgaaaggaggttcaggctttgtggaggcggaggctgtggtcccgacgtagaagatgctgcagggggcggcggctgaagcagcgacggaggcggaaaatcctcggaagatgtggcattactaccgacgccggtacctgctgcattgagagcagaggcgctgccactaccgctgccccttcgagggaacattgccgggtgcgccatcttcctagcgctaatgtctgcagcggcggcggccgcggcggtggactcaggcggctggtgcattgtgttgggtaccgggggcgcggaggagacgagtgcaatttccttctgcaccgtaatctttgtattggagacgccggagaggaaaacgggacctgacgctccgcctggcgcgattcctccttctcctcctcctcagccaaaggcgccggtcgctcctgccttcgagagcgagcttcggaaaggaggatgaacgagggtgaacagggcggccggggacccgaaggggggatcccttcagtccttcgccattcactttcccctctagcctcacacccccctttatattctgcttcacgtggggtgcggggcaggagggagggggagagcgcaggaaggggaggaaaagcgagaaatgcccaccttctccggccaactccgaagccgcctcagccccctcctcccgccgcgtcggcggccgctgcaaagccctcccggccgctctgcacggaggcagcgccaagcaaatgtcgccttcccctcgccacccccggggccgccgccgccgccagcgagccccgagctcagtgtcgctcaaacctcccctcccggccccgctcggccctccccccgcgccccgcagaccctttcaaaccccctgggctcgcggcggctgctcggtgaggaaacgctggccgcggctggggccggggcgacgcggctgcgagcggggcggcggcgaggcgcccggtacggtgagcccagcaacgaggcgcgggcgggcgcgcagagacgccgggtcctcgcggagcacggccggggcgcggcggcggcggtggcagcgggagcccagggaccgctccatcactggcagccatggagcccgagcattttcctccctcagggcaggcgcctcgactcggcacacgtcctcggggaggaaggggccggcacccgagcctctccggagggcggcgggacgtgcgctagggcggagggtgcgaccctctcttatcctcttcctccgcagccggctcttcctcaccccgctgctc

SEQ ID NO: 83576 - DNA, 566 bp, Homo sapiens
ggagaatgtggcacagaaatggtaagggggggaacccatacttatttcttcaacagacttgtacagaagggccatggttgctactgctctcacacaaggaggcagccctcaagccaccgggtccaggtgttggctaaaatagcctataggcctctgatgatcaccatgtttctggatcagtaccctggatgcagtacctccagttttgtgtgtgaaaagggagaaaggcagtttgtagtttgggtgccctaaggctggggcattagttagaatttcctttatttgttgtatagctgattgtccctcaagagtccacaagatgggatcagtttgttcattttttaagtatgcctacagagtttgagtcataaagaagaatttggtatccagtttctacaatagccagccaggacccaaaatcctctaagttgtttattagtcacaggcattgggaaagctaaaattcctctcactctgtcagggttaatactcagtcctttgactgagataatatgcctccaaatgcttaacttgcagcaagcatggctgaagtttgtctttggaca

SEQ ID NO: 83577 - DNA, 472 bp, Homo sapiens
  misc_feature (79)..(79): n is a, c, g, or t
  misc_feature (105)..(105): n is a, c, g, or t
gacaatctactaccaagaaccagctccaagaagaaaacatctctgggaaacagtaccaaaaggagtcactgaattgtcnttggaggagtccaggatagctcttcntgttattttcaccttgaggaattgtccattacatctatgagccttatgtgtggctttctccgatatagaaacctatcaggtgtcttttagatcatttcaaaacactggcttattctttcttatgtttccaactgaagtctgcatcccaagatgtagtttcactgctaccccatatggcacccttgtacgaatttgaaaaaagtactcactctaggcacatgcagagccatgcctgcggggacagcttagagagtagagggtgggctgaactccagttactctcgtacagggatccacctttttgcagaaatcacagtgtggctatggtgtggtttgatttcataaaacagatgcttaaaaagtaaaa

SEQ ID NO: 83578 - DNA, 486 bp, Homo sapiens
tcagttaaaaagactgggctgagagaaggtaaacaactctctcaagttcagagccaagctgaggaggagggcccaagctgaaatgggtggccctctatgtccactgcaagaaccagtccctctggtcacagacatccagatactggagaagtcacggtccatgtctgggttcctctagctcagaaacaagagacttccagagcccacttagttggaagtagaggagtctgtgtatctataaaatctcaggtggccttttacttagaaaagcaagttattttcaagtaccctctagtgaaatagttacacacaactaactggccagactaattggaagtcattgtaatctattaatcaaaataggatcctttaagaatccccccactgggaaacacattaacttaagatgctatggatattgatatttaccatttgaaaactggaatttaaaaactgtttaccagattttatcttgaactcagacca

SEQ ID NO: 83579 - DNA, 3506 bp, Homo sapiens
  misc_feature (3498)..(3506): n is a, c, g, or t
gggttccacatcagccaccactcctgcttctgagcacagggtgctctcctcttgagctcagcttctgattttgcagccaagcattcttgctgctgctgcctgcctgcccacccgcctgggcttgcagcccgccactttactttctccagccctgataccagctgagaagtctccctgcagctgctagttcctgcccaggaccatgtgtgtggatgctgcttgggagaagcgggcacttgctcctggcactgatcccagctgagtttctcctgttgatttctggaccactgatgctgttgctgaggaggtatttcctggcatccctccccctgagacaccggctaaggaccagcctaaacgcaaggcaggacagtgtcaggatggaccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcattgtgaacggctgcgccgccgacctcagcgtctgcgccctctggatgccgcaggaggcggtgctcgggctcctgcccaccggctctgcggagccccccgcagactgggacggcgctgggggcagctaccgcctgctacggggtgggctgctgggcctcggactcacggtgtccctcctctcccactgcctcgtggccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgaatccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcacgcggccagctggctcctgtgctgcgccctgtccgcgctcaacccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatggggccttcgaccccagcgggctacctgaaccaaggcgtctctctaagtggggcgcccgaagtcattttggacggccacctgatttttaccctttgtttctgtgttttagaggaatcctaaagtcaaaacaccagagacttgaagaacttgcaaactggcgttttaaaataaccggttaatttatttccacacagtttgtttttgaaaaagagctttcataatgtataaccctttccactttcatcgtcttatatatgaagcgccttgagtgtgcatgaaccaaaggaaataacattgaagaaggaaaacaatatgtagaaagtattttagaaagtaacctgtctttgatgatgcttctcttaccatttagtttttgtatattaccctggggcagtgaagccctaggtgtgcccaccagtatgagttgccattaagacctcaagccctttattcttaaaagggtttttaataaagtctttctcaaatgaggtagaatcttagccagtgagaaaaaaaattattttatgctccttttttttcgcactcttaagactgaaaattggcgttgagtgttatagtgaaaattttccagtttgataattgatggtcagagccagcactggaattttgaaaacaaataaggtgattatctattttaggtaccgtttcacattttctatagcatgcacacttgttgctaccctcattttgtaaccaatttatttgccttatgaatgtgattgcagctttgaacattctgtactgtaatggttgctaagaagaataagtccttctgttttctctttaacatttaaaatatctcaatgcacatgatataattaaacactaataataccatgactgcatagctaatattagctgctattgcatgctcctagatgctagaacttattgggcatgtggtatactgaagcgatacccgttagacaaggatattttacttcttccagacaccagaagaaatggccttcaattatttgaaaagagacacagagacacctctggctacctagagttcttcctgtcttgaccaatttatgagaaagctcccagttgggactttatctcacaagtggaatcacagtcaagacggatcaataatatggtttggctcagcaaagccagctgtgctcttttagggtttaaacaagccacacgttagaaagcaacactgtttttatgtagttcatatatattaccatgacatttaacatcaatattgtatatgttgaaggaggtataataaactcagtcatatatagtgaacagttcaaatgggaaagtgttctaaaacatattatttgagatttgtcatattcatctttggtttactaaatttacttagaaatatttgaaatgcaaaattgtgtgaaatcaccttatcaaattaaaatgggaagaaagtaattttaataatttttaataatcatatgtcagcattctgactacttaccacatcaaatctgggcccaaacagcctcagttaactgcataattcaggaacaaaaccagcttgctttgttgcacgcctgggcaatttcagccaggacattaggaccacttgttgtacatctgaataattatggaagttgggacatgttaaggaaaacaaatatgttcatcaccaacaatcagctgtcattttattaatctatcccttttgtgcatgcaccatttctctcttactaacagtttcatctgttcacattttccttgattcaaatattaaagttcagacaactattctgannnnnnnnn

SEQ ID NO: 83580 - DNA, 348 bp, Homo sapiens
gatccacgggcctcagcctccaaaagtgctgggattacaggtgtgagccaccgtgcccagcctaaatctctaataaattgtctttttgaagcagaagtttgttttttactggttaagttgatcaaataaaggtggtgctactcatgtaagcataagaagagcccatttccaaggttcttaggtatgttgatagttctgataaggatctattatgtcctgccatataacataacaatttaatgtcttgaaatagtagtttcttttttgcatcttagaatttagtaaagaaaattaaattaaacttcatagtttagtgtaatcaatgtatttagttttaggaaaaaacaa

SEQ ID NO: 83581 - DNA, 740 bp, Homo sapiens
ggaaagtgaagtagtttacatagttcactgtactatatttcagctgtggatcatcctgctgccagtccagctgctgcaagccctgctgctgccagtccagctgctgtgtccccgtgtgctgccagtccagctgctgcaagccctgttgctgccagtccaactgttgtgtccctgtgtgctgccagtgtaagatctgaggctctggacccagaccttcaggtttctcctgtttggtgaaagcatttcttatggttccctgagtcagttcgtcccacacatcctccctgaggcacctgcacctgctctagctcaccatccatgcacacacctccttccatggctcagctctcctctgggccctgccttcagcctcctcactccagaaacgtgtgtttccctgatgcgggaggtgtcctcgcctggacgcaggcacccagccgactgccacgatgttccctgcacttgggtgtggaccatcttcttcttctccctgggctgactgagatgcaaggtctgaccccacaaggccaggccgacgtttctgagtgatcactaagaaccagcttctcaaccaccatcaggaccctggatcctcctgggccgctgcctgttctcctgtggcccaagtgtgaccaggaaggtctctttccttcctgttgtctccatctgtttaaaaaaaaataacaaaataatgaatgaatttccttgcaataaagcctctcatgtctgtaaatcaactg

SEQ ID NO: 83582 - DNA, 308 bp, Homo sapiens
aggaaaaaaacataaagactaaaaagaatctgtttagccaaaatgaagactatcttatagttgagtagatgcaaggtctgaccccacaaggccaggccgacgtttctgagtgatcactaagaaccagcttctcaaccaccatcaggaccctggatcctcctgggccgctgcctgttctcctgtggcccaagtgtgaccaggaaggtctctttccttcctgttgtctccatccgtagtgacgttcctcaatcccagtgacgttcctctatccagtgacgttcctcatcccagtgacgttcctcatataa

SEQ ID NO: 83583 - DNA, 752 bp, Homo sapiens
tcaacgttgctctatctgacctacctatcagaccaacaacaaaacaaagttgaggctgtggatcatcctgctgccagtccagctgctgcaagccctgctgctgccagtccagctgctgtgtccccgtgtgctgccagtccagctgctgcaagccctgttgctgccagtccaactgttgtgtccctgtgtgctgccagtgtaagatctgaggctctggacccagaccttcaggtttctcctgtttggtgaaagcatttcttatggttccctgagtcagttcgtcccacacatcctccctgaggcacctgcacctgctctagctcaccatccatgcacacacctccttccatggctcagctctcctctgggccctgccttcagcctcctcactccagaaacgtgtgtttccctgatgcgggaggtgtcctcgcctggacgcaggcacccagccgactgccacgatgttccctgcacttgggtgtggaccatcttcttcttctccctgggctgactgagatgcaaggtctgaccccacaaggccaggccgacgtttctgagtgatcactaagaaccagcttctcaaccaccatcaggaccctggatcctcctgggccgctgcctgttctcctgtggcccaagtgtgaccaggaaggtctctttccttcctgttgtctccatctgtttaaaaaaaaataacaaaataatgaatgaatttccttgcaataaagcctctcatgtctgtaaatcaactg

SEQ ID NO: 83584 - DNA, 1045 bp, Homo sapiens
gggctgctgtggctgctccagaggctgtggctccggctgtgggggctgtggctccagctgtgggggttgtggctctggctgtgggggctgtggctccggccgtgggggctgtggctctggctgtgggggctgcagctccagctgtgggggatgtggctccagatgttatgtgcctgtctgctgctgcaagcccgtgtgctcctgggtgccagcctgttcctgcaccagctgtggctcctgtgggggctccaaggggggctgtggctcctgtgggggttccaaggggggctgtggttcttgtggctgctcccagtccagctgttgtaagccctgttgctgctcctcaggctgtggatcatcctgctgccagtccagctgctgcaagccctgctgctgccagtccagctgctgtgtccccgtgtgctgccagtccagctgctgcaagccctgttgctgccagtccaactgttgtgtccctgtgtgctgccagtgtaagatctgaggctctggacccagaccttcaggtttctcctgtttggtgaaagcatttcttatggttccctgagtcagttcgtcccacacatcctccctgaggcacctgcacctgctctagctcaccatccatgcacacacctccttccatggctcagctctcctctgggccctgccttcagcctcctcactccagaaacgtgtgtttccctgatgcgggaggtgtcctcgcctggacgcaggcacccagccgactgccacgatgttccctgcacttgggtgtggaccatcttcttcttctccctgggctgactgagatgcaaggtctgaccccacaaggccaggccgacgtttctgagtgatcactaagaaccagcttctcaaccaccatcaggaccctggatcctcctgggccgctgcctgttctcctgtggcccaagtgtgaccaggaaggtctctttccttcctgttgtctccatctgtttaaaaaaaaataacaaaataatgaatgaatttccttgcaataaagcctctcatgtctgtaaatcaactg

SEQ ID NO: 83585 - DNA, 887 bp, Homo sapiens
gattttccattttattttgttataaatctaaaactgttcttaaaaataatgtctgttaattttttttttaaaaaggaaagaagcactgatacatgctatgacatggaagaactctaaaaatattaggctaagggaaagaagccacatacacatacacatacacagatagtttatggttccatttatataaaatattcagaatagaaaagttcatagggacagaaagtagattacctggggagtagggggtgaaaaatgggtagtaactgcttaatgggtatgaagtttcgtttagggcgatgaaaatattctggaactagaaagtgatgatgatggtcacacagcaatgtcacatatacaataccacagaactgtacactttaaaatggttaaagggttttattttatgttatgtattttaccacaattgaaaaaaatgtttattaaaattaatgtgtaaacatttgtggaagaataatgtgtagtttctaacatttatgtgtttaaatttatgagtttaaaaatagaaaaaaaaatgatggcccagaagagcaagttcagagtgctgttcatgagtgatccgcatgggaccgcgatgcctctgacgtctgccatcctggagagcagcagagcgtcactagcagccaaacaggaagacaagtgtttcacggacataagaaatttaaagtggaagcactttctagagcacacaaaacagcctccctaacacatgagaagtcaccagcaacacagaaatcaccaacaagtaggtcaccacatttttaaagatcataggaaattgttcacgccaacaaatctcagtgaacctcagctctcagccttgaaaacaaggatggctgtactactcacttttttcttcttcttcc

SEQ ID NO: 83586 - DNA, 899 bp, Homo sapiens
ctcctgcttgccggcctggcggtcctactcaacaccgcaagatttcaaaagggaaattcctccagggctgagtcacagggaagaaagcgatttcctccgcctcttccaaagcggcccctttggtgccagtctgctggagtttgctggaggtccactcctgaccctgtttgcctgggtatcaccagcagaggctgcaaagcagcaaagattgctgcctgttctttcttctagaagcttcgacccagtggggcacctgtcagatgccagccagagctctcctgtatcaggtgtctgtcggtccaagctagaaggttgtggggctagacaagaaggaaaaaaatcactgtcctcatggaagttaaattgtactgacaaaggaggaaaatgtcagggagttaacaattcagtctctgtggcttcctcctgtcctctccctgaaactgagatccagccaatctgcacatttattctgagagtggccccactttaatgactacacccagctgtctacacaccaggaggggagggaactgtatcctgaggcaccaacccgattacccacccaacagccacagggacttccagtgactagggcatcatcctcaacgccaccaacccctctccttcctgtggcttttctaactggaactggaactcagaaagtacattaatcaccaatttgggaagctataggaaagtatgttttctaatatacagtgagagaatgtgactgataaaaccaattttcttgagactttctccctggaaagtgaatatatgtattcatagggccttcacaagcacagactaacaagcaaagagctacattcactaggaaggaagactcaaaagtaagtgaaaaataatagttaacctttagatgttgtgcaataaattat

SEQ ID NO: 83587 - DNA, 425 bp, Homo sapiens
taaaattaatgtgtaaacatttgtggaagaataatgtgtagtttctaacatttatgtgtttaaatttatgagtttaaaaatagaaaaaaaaatgatggcccagaagagcaagttcagagtgctgttcatgagtgatccgcatgggaccgcgatgcctctgacgtctgccatcctggagagcagcagagcgtcactagcaggtcctcgtcttctcacttcataacattctttccaaaagtcttgttgacattcttctgtcttccacatatagtttatcttcttgaactcattataactttaaaatatttttactgtgttacatgtactgcttatatttgtttattttataattattaattttaaattgtgcactttattttgctctaacaataaaattgacatgttcgtatagatgatacataatt

SEQ ID NO: 83588 - DNA, 1222 bp, Homo sapiens
ctcctgcttgccggcctggcggtcctactcaacaccgcaagatttcaaaagggaaattcctccagggctgagtcacagggaagaaagcgatttcctccgcctcttccaaagcggcccctttggtgccagtctgctggagtttgctggaggtccactcctgaccctgtttgcctgggtatcaccagcagaggctgcaaagcagcaaagattgctgcctgttctttcttctagaagcttcgacccagtggggcacctgtcagatgccagccagagctctcctgtatcaggtgtctgtcggtccaagctagaaggttgtggggctagacaagaaggaaaaaaatcactgtcctcatggaagttaaattgtactgacaaaggaggaaaatgtcagggagttaacaattcagtctctgtggcttcctcctgtcctctccctgaaactgagatccagccaatctgcacatttattctgagagtggccccactttaatgactacacccagctgtctacacaccaggaggggagggaactgtatcctgaggcaccaacccgattacccacccaacagccacagggacttccagtgactagggcatcatcctcaacgccaccaacccctctccttcctgtggcttttctaactggaactggaactcagaaagtacattaatcaccaatttgggaagctataggaaagtatgttttctaatatacagtgagagaatgtgactgataaaaccaattttcttgagactttctccctggaaagtgaatatatgtattcatagggccttcacaagcacagactaacaagcaaagagctacattcactaggaaggaagactcaaaatttaaaaatagaaaaaaaaatgatggcccagaagagcaagttcagagtgctgttcatgagtgatccgcatgggaccgcgatgcctctgacgtctgccatcctggagagcagcagagcgtcactagcagccaaacaggaagacaagtgtttcacggacataagaaatttaaagtggaagcactttctagagcacacaaaacagcctccctaacacatgagaagtcaccagcaacacagaaatcaccaacaagtaggtcaccacatttttaaagatcataggaaattgttcacgccaacaaatctcagtgaacctcagctctcagccttgaaaacaaggatggctgtactactcacttttttcttcttcttcc

SEQ ID NO: 83589 - DNA, 485 bp, Homo sapiens
  misc_feature (437)..(437): n is a, c, g, or t
  misc_feature (446)..(446): n is a, c, g, or t
gtgtgagccactgtgcccaccataatccatttcttaagtctctacaacaccacatcctcattgccttcattggtttgcctcttccacagtatgtttttctcccacagtaattaattcaatgcagatttggtttacactatgcatcaagcatatgctagacactaggaatacagcagtaaaaaagaagagccagagaggggagatgtgcagattggcagtgcaaggtgaggaataggcactagagcaacattgaaagagagtttggagcaatggccttcttcttcttcttttggtttgtttactcaggtagtaattaaaaaaaaaaaaaaaaaactatgtttttcctctacacggttggttttttttgggggggggggggacgaaatctcgctcggtcgcccaagcgggagggcacgggcgcgatcgcgggtcacggnaacctcggncttccgagttcaagcgattccttccacaggttttaaagg

SEQ ID NO: 83590 - DNA, 646 bp, Homo sapiens
gtgtgagccactgtgcccaccataatccatttcttaagtctctacaacaccacatcctcattgccttcattggtttgcctcttccacagtatgtttttctcccacagtaattaattcaatgcagatttggtttacactatgcatcaagcatatgctagacactaggaatacagcagtaaaaaagaagagacctgccctcaaaaatattcattctagtttttataatgattttagtataggctcaaaaggcttcctaaagattaagttcaaatacatttactaatgggttaaggaacccagaatcctaactagggtcggacagttggagctgagtgtttgttgaaaaggacttaaggtgtttagtccagcttcctaagccacatagtgatttcttctgtagtggcccaaacagaagcatacccagggtctgcttgttttagtttcagtgatgaggatgcttaccccagcctccctcatttattcattcaggaaagaaatgaccacctactcgctgagagcccaccgtgtcatgggcgctgaagcactgtcataaacagatgctggagagacttaaggattaaaacgttctttctagcactgagaagaaatctgttttcctgtgtttgtcaccactgcctctagtata

SEQ ID NO: 83591 - DNA, 742 bp, Homo sapiens
gctgtgtcttgcagcctgtgggctttttctggctgctgtggcccactacgcctgcagcaggactggaggcttgcaggactgatacccattccccagagcaaccctcaaccaatgaccttcaggattgggtggataaatatcccagctctcttactcttcagcaccatgagaagagcttctcccctgtaaatggccactctcacttgtgggtccatgactagctgaactgaacccattccacagtaaggacccaagcccagcagatctgcagccaaaaccaaagttgctcagtgggacccatgccacataagccgacccatggccaacctgaaaataaattttcagccaagacattcttttgcagcctaagagggttattatggagaggtggaaagatcttcaaacctggaaggcttgcttcaaaccccagctctactccaactacaggattggggcagaggctggaagagctaaaatgttcatttctcagcctctccttctgccagcaataagacactgggaggtctgttgatgtggcagatggcggtggcatgccctgtgtcccatgcccacagtctaatcacctctgacttcagtcacagctgtggtggacagttccgtgtgttccaattcacctcatgcaagacagcatccagtctcaagtgtggacttctaacagccatcttatatcacaaacgtcatctctgcttccagagggcacagcctagaacaggaacaaagg

SEQ ID NO: 83592 - DNA, 2864 bp, Homo sapiens
gcctcccctccagggccgggtggggtggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctcaggcttgccactgataatgaagggcttggctgggaggccactccccattcccagctcccacgatggaagtcagctgggctggcattcaggagtccaagaaggggatgacccctcagctttccaactccagggaaactggcagaaggtggtaaacattctctggttgccgtggctacaggtgtgacttcctggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaagtcacgccgggcgcgcactcccactccctctccgcacgcggctgcgggacgcgatggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 83593 - DNA, 2669 bp, Homo sapiens
gcctcccctccagggccgggtggggtggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaagtcacgccgggcgcgcactcccactccctctccgcacgcggctgcgggacgcgatggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 83594 - DNA, 2709 bp, Homo sapiens
gcctcccctccagggccgggtggggtggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctcaggcttgccactgataatgaagggcttggctgggaggccactccccattcccagctcccacgatggaagtcagctgggctggcattcaggagtccaagaaggggatgacccctcagctttccaactccagggaaactggcagaaggtggtaaacattctctggttgccgtggctacaggtgtgacttcctggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 83595 - DNA, 1318 bp, Homo sapiens
gcctcccctccagggccgggtggggtggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctcaggcttgccactgataatgaagggcttggctgggaggccactccccattcccagctcccacgatggaagtcagctgggctggcattcaggagtccaagaaggggatgacccctcagctttccaactccagggaaactggcagaaggtggtaaacattctctggttgccgtggctacaggtgtgacttcctggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggcagccccacctcttgagagcccccagtgccggagcagaaaggaccctggacccagaggcagatactgcggggtggtagaaaaggtagagtaggctgtggcaatggaataaaacacgattaaaaacgttaaaaa

SEQ ID NO: 83596 - DNA, 872 bp, Homo sapiens
gcctcccctccagggccgggtggggtggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctcaggcttgccactgataatgaagggcttggctgggaggccactccccattcccagctcccacgatggaagtcagctgggctggcattcaggagtccaagaaggggatgacccctcagctttccaactccagggaaactggcagaaggtggtaaacattctctggttgccgtggctacaggtgtgacttcctggtaaggacttgcaaagcagcagcccggccctgagttctggcccctcagaggtttccagtggctgattcacagggtcagggccagccactgcagagctgcacagagccctggattctgctgggttccagagagatgtctccagtgtcccaccctgtatcctggccttcccaggtctgcatccacaggatgggagtgggggtgacccttgctcgggcctggggccactgccagggcacaaggagacaagggtgctggccagcacccagacccagcctacaggcactgcccaagccaggcgtcaaagagaaagtcttgctgcctgttctccttccactggggcagtcaatagctccggtgttgggatcaggtagatccaagtctggatcctagctcttcc

SEQ ID NO: 83597 - DNA, 291 bp, Homo sapiens
gaaaaggataaggaagaggcccctggagagaggcaacagcatcagggaaggacctgttttggaagcagacagttccttgtcatgagggtggcagtcgacccatgagagcagaaagcagaggaggggatggtcccagaagcccagggttggtccctgggagccagctgagcctctgccttccccacaggtgcgctcagccgtgaggaagaggtggcaccgctggcaggaccatcactcccttcgagtccccatggcccgggccatgtccatccctacatcacccacacggat

SEQ ID NO: 83598 - DNA, 480 bp, Homo sapiens
aaatagattatttctattttattcatcacagaggcagctacatatatttgaaaaatattagggcatatattatgaggcatattatttatcctatccatagatgatataaaaatccaaatggactatttatttattttttattattttttgtaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtatctgtcctttcttagtgactcactgggctgaagtctagagcattccaatgggtgctggggatgggttagtgaaccaggaccagccctgcccttgggg

SEQ ID NO: 83599 - DNA, 2287 bp, Homo sapiens
gcctcccctccagggccgggtggggtggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 83600 - DNA, 2442 bp, Homo sapiens
gcctcccctccagggccgggtggggtggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcagtcacgccgggcgcgcactcccactccctctccgcacgcggctgcgggacgcgatggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 83601 - DNA, 2514 bp, Homo sapiens
gcctcccctccagggccgggtggggtggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 83602 - DNA, 802 bp, Homo sapiens
gcctcccctccagggccgggtggggtggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggcagccccacctcttgagagcccccagtgccggagcagaaaggaccctggacccagaggcagatactgcggggtggtagaaaaggtagagtaggctgtggcaatggaataaaacacgattaaaaacgttaaaaa

SEQ ID NO: 83603 - DNA, 470 bp, Homo sapiens
ttttatttttttcactgttactgttttttatctttgattgataaaaatgaaaatgccaaaatgagggttagcttaatttaaagtataagcgtagttagcagctttttctaatcactcctgtccatttaaaaaataatcctcataggagtataaacagaggaaggagaaatggaggatgggcttaagagaaagagtatttcacaaatgtctgcatagcaaattcaattcatctacctagtagctccttccgtgttaacctacaggtgttctcccctccaaaaaaaagcatcttttaggaagaaaccaccttaacactacctttagaagattgaacttccagggataggttgtttgagagaatcaccaaaagccatttttaatgaatttttaaattacgctttctcattcttataatagtgtagcagccaccttccatctactatgtaacttataacaaataatcaagtact

SEQ ID NO: 83604 - DNA, 1108 bp, Homo sapiens
tcacccaacacaaccccaaatcctttaaaaagcccttcccagcaccctcatactgaggcaccccatggttccccatggtgtgtgatctctcttgtgtaaaagtgtgctgataaacccaactcgattcaactgcagatctgttcctcatgatctctgacgggtggacattgacaataattttttgagcttagattataactccattttatatttttgttgtagatctgcagtacttgatttgctcaaaaatgcaattaccagttaagtgagggaaggtcgtagtctttgttcagtacgtaaccaagagttttctatcattttaaaaactgtcactagtggcaacattgctcatggcatttgagttccaggtcaaaactactgcagtagtctgcatttgtagtgggcacattaatggtaattatatgtacatgtgcaagcatctaatgattgtgtcatcaggagttttggccatctccagtttgaattacacattaccgtaagttgcttccttttatttgtctgttacattacagttagatattaaagatacctttaatcatgatagatgatttaaaaatatgcctcacgtaagttatattgtttgtgttttagaataataaaacatgtttaaaaataaacaaaaaaaaaaaaaagaggctatttcccctatcatagaagagcttatcacctttcaggatcacgccctcataatcatttccttatcggttcctagtccggtatgcccttttcctaacgctcacaacaaaactaactaatactaacatctcagacgctcaggaaatagaaaccggtctgaatatcgtgcccgacatcatcctagtctcatggcctccaatccttaagaatcctttacataacagacgaggtcaagatcctccttacatcaaatcatgccccatgtttgaactagagtaacgatacggggttattcttaatctaatattccctatatctaaacagggctgcgatctggagtgaatggttgtacccgtgaccatgttaattatccaagtgtcctggcgccattggtaaagatgtccgggtacacttcgccaagggttagcgtctttgggcatttcgctaaata

SEQ ID NO: 83605 - DNA, 456 bp, Homo sapiens
cagttagatattaaagatacctttaatcatgatagatgatttaaaaatatgcctcacgtaagttatattgtttgtgttttagaataataaaacatgtttaaaaatatttctgataaaaagtggctgtgggcctgaaggggtgaaaaccattagtctacagtcattgatgaacagtctgtcccttaggccctcttagttggagctgaagagtgtatagatacgaacttgaactctggtgttctaatattctgtgttgcttactgaaggtagatgccatgtgctttggaaaccagcatggacattctatgaaatttgagaagagaagcagttttctcatttagatggtctatcatgggtggtaatatctagtgttctaagtgaatgtagtagatgctgcttatattaatttaagagaaatcctatatatcccattaaaaaaaatcgtagagaaacatt

SEQ ID NO: 83606 - DNA, 969 bp, Homo sapiens
ctttctgtaagcactgtgcacatgataagaattattgtctggcatagtttttgttattgttgagcaaataagcttcaggtgcttttagaatcttaactcagtattttaaaggtgacacatttattaccatactattaatagtactgtaatgtttctttttaggtgtagagttaggagacaatcttgaaaaattaggtaagaaggaaattatgatggaaaatttcaaacatatataaagtaggcccagtagaatgttctgcgtactcatccccaccttcaacattgggcaactcatagccaattttgtttcatttctacactctcacctcccctttcttatgttatcgtaaagccaacatgtatttattttcttcttcttgtttttttaacctttttgggatatgtagaaatacttttaatattcttttaaaaatctaattataagtactaaaaaagataggttggtagttgagactaaaggactgttatgtgaatgagttattctctgacaggaactagcaggtaaacaggatattttatttctcaagattttcatatgatggtgaccaactgcattgcaaaagaatggtcacattccagggttgtaactagttctggaggcttagttacgcaattgccggctctgtcatcttctacagggatgtgaccttacggaaaagtaaggaatctgaagcgtggcagatcactttgaagcttgcccagtttttgcatgttatcatgtaatagtgctaaaactttttgtcctccagctaggcaacataggtatgtaatttagactttgggaatactgtagagctgtgataaaccctgctttaagctacattctgggatcgtaacatgtaatttagaagtcaaaatccacttagaagaaaagaatttttaaagcacggtaaatcagaaccatttttgtgattaatttttattgatctttttaaatttttcataatt

SEQ ID NO: 83607 - DNA, 716 bp, Homo sapiens
tgattgaacccctgcccaccccagtctgtttctttatctgcctccctgctgggctgtgtatttccagcatggccctgagttggtgctcagctgttagcacatgacacggtgtcactgaacacgttaccccaccttcaggagacccttcctgtcttgtgggtgtgggttttgcaggaagcatctcttggaacagaggagaaccccaagctgccttgggtgtgagaggcctgggctgtcggcccccattgctgctggctggtgtgtccctcctcgggcagggagggccctgccacaccctgcacttcctctcattgtgcctcccttcctgtttagctagactgttaggctggagggatttttcctccctttcaggacctgaatggagctatttctccttgcatctctgccaacatctcccaggatccacctctgatccactggtgggctcgggcatcaacagctttgggttccaatcccagctgtccccattcagctgggtggtgagaagccagggtctcacctctctggacctcagtttcctcacttgtaaaaagaaaaataacaaggtggctcgcgtgtttttgcgtgggattatgagggtttaatgagctaaggatgtctgtgcttctgggaagtgtgagccatggctgtgtcacccttgtccctgaccccgctgatgtgggggctctgcagagagcccagctgggtactcactg

SEQ ID NO: 83608 - DNA, 593 bp, Homo sapiens
caggaccttgcctcataaaggacgaaggattcggcctaacaaagggcagcactggcgaaagcaaggcaccaacagagaagcgctgtatgtgaacaaaaccaagacaggcgctgtccagaggacacaggagcccttgcaagcctggaggatgaaggcagggtgtgcgtgaggggaatcccaggtgactcaggtctcagctcgcacttggggagctgaaacccaaggctcagccagggccttccctctcccgacagctccctgcagacaggcaccaaccacacacagggtgtggggaaaacggcagcgcggaggctcacggagcaggcactgcagatgcaggagggccaaggtgtgcaggagctctcaatgcagaggtggggatggagtcactgtcacccctgcacacgtgcacacgatgctccccagccctgtgcactgggggcgctggcagcagccaacaccctagctgcaacaagcacacgcagcgcccagaccctgagtcctaaacacacccagaaggaaccagggcgccctgcaggagcagctgtcccacctagagccaccaggagcagcgcccagaccctgagtctctt

SEQ ID NO: 83609 - DNA, 582 bp, Homo sapiens
ctcgcctgctttaatttcttgagatattacaaaataaaatattacagttattgccttattcacagtatacaaaggtattttatcatacaaactgttgatcctacagggactggtcatggaggagagtctatttttggcctaggattgtatggtgatcaagcaagcttttttgagacagaaaacgtcccaagaattaagcacaagaagaagggcacaatgtccatggtgaataatgacagtgatcaacatggatctcagtttcttatcactacaggagaaaatctagattaccttgatggtaccatacagtatttggtgaggtgacagaaggcattgacataattaagaaaataaatgagacctttgttgacaaggactttgtaccatatcaggatatcaggataaattatatagtgattttagatggtccattttgatgacattcctgatttattaatccctgatcaatcaccagaacctacaagggaacaattaaagagtggtagagttgacacaaatgaagaaattgatcatttcaaacgaaggtcagccgaagaagtagaagaaataaaggcagaaaaa

SEQ ID NO: 83610 - DNA, 474 bp, Homo sapiens
catgctagctatgtaataactgtaaaatttggccacaaatgcatttgctttgagaaaaatgatcatgtgaaattcctaaatatttgggccatatggaagatgatatcagaagaataatatattctctgtatgtcaaaggaggaggataataaaaaccgtagttattaggttagtacaaaaacaattacagtattcgccattgccaaaaattgcaattgcttttgcaccaaggtagtaataaaagtatggttgagtttctgtagaattccggcaaaggatgagcatccttaatctgaaatccaaaactctcccaaattcgaaattttttgggtgcccatatgatgcctcaagtacaaaattctacacctgacctcatgcaatgtatcatagccaaagcacaggtacacaacacatagtttattcagtgctttcaagagaaaattaaaattaacatgaggctacatgtaaataaat

SEQ ID NO: 83611 - DNA, 198 bp, Homo sapiens
tgagccactgcgcccagcctgcaaaaactctttgaaacaaaggtctgccaaacaatttgtctttgaattactgtttatggtatgcctgctggttgttcaaggagtccccagtgtcccaaggaatttaatttaaaattacctgaaatggtttctgcataaatatgttccttatagcatttttttttttttttttttttt

SEQ ID NO: 83612 - DNA, 520 bp, Homo sapiens
caaaacaaacacaggataggccatataagacaattatcttcgtagacaatataaacaaacatttgaccacttattaactatgcctatctaatctgtctccagaaagcagtttataatgagaaaaatatacaataatgttgataaaattaacataaattaaatatatgaattaaaaagaaaccaccatatgctaatcactcagcctgatgagccactatgataaagattacatttatctgaaggaactggtgctgctgtataagatcattcacttcataaatccttgacgaggactgacaatatgcccgccactaggtgaggctggggatacaacagtgaacaagacacaagatttagagcaggagtgtccaatcttttggctttcctgagccatatcggaagaagaattgtcttgggacacacataatatacactaacactaatgataactcatgagctgaaataaaattgccaaaaaatctcataatgttttaagaaggtttacaaatttgtgttgggc

SEQ ID NO: 83613 - DNA, 248 bp, Homo sapiens
gatggccgtataagaaaataaacaacttgctaaaactgctgaaactccctctgcttgtgagatttaaaaaaactggctgaaattggttggaaccaacatgtccaatggagtctgaatagaaagagcttgctgacatcacagcccgaatttccaccacatttcatactaactccccctgaatttgcatatgcaaaccacaagcaagcatgatcaaacagacaactgcgcgtgtccgaggactttccaga

SEQ ID NO: 83614 - DNA, 404 bp, Homo sapiens
tcttcgtaagctgaggaggatgtatgtcacctcaggaccctgtgatgattgcgttaactgcacaaattgtttgtagagcatgtgtgttagaacaatatgaaatctgggcaccttgaaaaaaagaacaggataacagcagtgttcagggaacaagagaggtaaccttaaactgaccgccagtgagctgggcagaacagagccatatttctcttctttcaaaagcaaatgggagaaatatcgctgaattctttttctcagcaaggaacatccctgataatgtgtccctaagggtagacctctaaaatggccgctttgggggtggctgttttttacggttgcagctgtagggatgaaataagccccagtctcccatagcgctcccaggcttattaggacgaagaaat

SEQ ID NO: 83615 - DNA, 788 bp, Homo sapiens
tataaacaggagtcttgttgcaagagtagatttataattccaaaagatctgttccaatagaataaggtgtttattttaagaatcttaatgtggaagattgaatctgaaaatgacaatcttattattaaataatggcgatattattaataatattattttattaaagtagacctcaaataagctctttgatttatcaaaaattttattggataaatattgaaatttttctgatttgccttactacttcacaacaattagctattcttctggataatctaaaaactttgaacattctactagtataatagaaaacaaattttgggtcgggcgcagtgccttattcctgtaatcctagcactttgggaggctgaagtgggcagatcacttgagggcaggagttcgagaccaacctggcaaacatggtaaaaccccgtctctactaaaaatacagaaaaattagctaggcaggatgtcacatgcctgtaattccagctactcaggcggctgaggcatgagaatcatttgaatctgggaggcggaggttgtagtgagcagagattgtgccactgcactccagcctgggcgacagagggagatcctgtctcaaaaagaaaaaacaaacaaaaacagaaaagaaaaaaaaaaagaccaggcccagtggttcatgcctgtaataccagtattttgggaggccgaagcaggaggattgcttgagcgcagaagtttaagaccagcctaggcaacatagtgatagccctatctctccaaataaataaataaataaataa

SEQ ID NO: 83616 - DNA, 494 bp, Homo sapiens
atttctccgtaaaggaaagtaaagtgagtcatattacatacaagccacaatacagaactgatctgaaatacactgcggaatggcctttcagtctatgctggactctaacaggaaaaaggcagaaggtggtcaatggtgcatttatttaaacccctcatttcctccctgacgagaagaaggacaacagttcttatttttcatattatttttgaaaaggcagaaaggttaattatatattgacatgatttggatctgtgtcctcaccataatctcatgtcaaattgtaatccccagtgtttgaggtggggccaggtgggaggtgattggatcgtggaggtggatttctcatgcatggtttagcaccatcttcttggtgctattctcgtgatagtgagtaagttctcacgagatctggttgtttaaaggtgtgaagaacctcccctctgtctctcttgctcctgttcctgccatgtaagatatgctggctccccctt

SEQ ID NO: 83617 - DNA, 793 bp, Homo sapiens
tttttccctgtctggattgtgtaaattttttttctatgaaaatgtgtatttgtgataaggaaaatattttttttaagatcccagaaaatactggaagaaaagaataacaatgagatttttcttttaaattttgccttattgttaaactatagaacttgattatacataaaatgaaatatgcaagccttaatttttttctttgtatgcttagaaaaggtgaggtaccttattacatatgatttttattagtttctggaggcaaatttaatttttattttaaaatccaaaatctattttaaaagaaatagttctcaaaaagacaatgatgactgggtgtggtggtgtgtgcctgtagttcaagctgctcaggagacagaggcaggagaaccacttgaggccagttcagtctagcctgggtaacatagcaagaccctgtccctaaaataataaaaaatttaaaaaccacaataatgtgagttacaaaaaagtgtaacttatgaaaagtcgtatttatattgacctttgtaagagctcaattatttcaggaagcaaggaatatcaccattctgagtaatacaatttcaactaatctttatttcttctacttgaagtcagtgcctatctaccacaaacattcctatatcagtgtgcaaattaatttggagacaataggctttttacgacaatgaattggttaacttttaaaagttgttttttatctcacattttataatacgataaataaatgtacagcagatctttaagaacattgtttaactataatgttgatggc

SEQ ID NO: 83618 - DNA, 532 bp, Homo sapiens
caacacactgcaagcagtaggataaggccaacttcaaccatgccccagtggcctggactcagccacttaactctcacaaacaatgagtctaccttcaaaaatcagatggacctgaacttcctctccctgaagcagaccaacgtaggatgaaagtaatcatcaccaaggacagtcagctaatcagcaccaaagccgcatcagtcagcatctgagaaacagcttattcacgggaccaggatacttaagtgacaccaactaagattcactctcatcagcagatttccctttggctagattacctttttatcacctcccaacatttttttgttttgttttgagatggagtcttgctctgtcactcatgctggagtacagtggtgtgatcttggctcactgcaacgtccacctcccgagttcaagagattctcctgccttagcctgccaaactgctgggattccaggcgtgagccaccatgcccagccttcctcccaactattttaggtttgggagtacatatgcagttttgttaca

SEQ ID NO: 83619 - DNA, 370 bp, Homo sapiens
tccagaacttcagggttctttaacctccacggtctccttgaaaagagagaggtgtgctctaccacttgtctaaggagcaagatggaaaaacaatgcaggagggtctatctttttaacagaaataattgctaatcaaaatgaacctttagaaactccaggcagtctcatggagataattttgggcagcacgttcttatgtaagccaaataaccctgcagggagcctgttgtggaactgggtcccctaagatcttcctaccttatctagagtgttccacgccattgcctcaaacccacacattttctaaaagttgaaggtttttcacaacatttcttatggctctatgaggcaagagaggtgcagccatttg

SEQ ID NO: 83620 - DNA, 276 bp, Homo sapiens
agatggaaaatattggtagacctgggagatagagatcactgaaaactagataacaggatagtttgagaggggcacctagttagtacaggacagtgctattctagcgacgacccatggctccatgagcaccatggaggtgcttctgaacttaaaactttgtttttatcttggtgtaaaatgcttcctgatatctcagagatgatgaaaaaccctcctgagatttgcaaattgagttgtttaaacctgttgcaagtataattccttaaacatgtacat

SEQ ID NO: 83621 - DNA, 842 bp, Homo sapiens
ctctctccgggtcttcgggggtgcgcgtcttccggccgaccctcctcctgctcctgctatgttgctgacccacgctgctggcgcgagtggtcttgcccctcgggacccgaggagggaggagttcttcgttcccttcagctttcaggccccagggagaacctttcagtcacaggcagcctaggttcaagaagaagaaaacctgaggcctcggctcaccctgacagggaagtggcgtggggaccgctaaaggactgcgaggttccactgcccagggctgtctaaccgcttgctttagactgtgggtgcacggagtccgtcactcagcctccaggaccagggctcctgatgtgtgagcgcgttccattcccccattcccacaagaaccctcgctcccgcgaaggcctcctgagcttgcgcgactccgctgggccttggagagctctggggagggaggcgcctctccagcacccagatccccagcctgcagcgcctcggggccagtgtggcccggaatggcaggtgagtttacaggggggtctccggggcctttcctaagtctatagacccatgtccttttgagaattctgaattgactccaaatggaaggcttaccatgcgattgaaaaaatcgaaacaaaaccgcaggaccctattcgtccctggcctcctctggctcatgctctgtgcatttgctggaacccctctctactgcagaggtcaccaggagggtctgtgcggggtctggggatgggtagcgaagcgcagtttccagtcctcccagcagcagctgttttcctgagggactttctgggacccagtgtgttccaggtggtggattcctc

SEQ ID NO: 83622 - DNA, 420 bp, Homo sapiens
ggaaggcaggaaaagttataaaaagttgcttctaagaaaccatcccattccaaccttttcttaactccgtgagcttggctcaatttaacattacataatgcagggtttcctcgttaattcatttaatctgcttcaatatgggcatcatgcttataattttcatatcactaaaactattgtggtataatgtccctataatgggaaaacggaaatgatcagatattatctaaattagcagatagtagatttcttgtgactttgttaatatgtaattcatttaagcaaacttaatatccattaactttccttgtaggggcccattagctttaataatacattagctcctttgtacgtcctgagtagatattcacccagtttccacccctaaactctttcagtattttcccagaatatctttta

SEQ ID NO: 83623 - DNA, 403 bp, Homo sapiens
catgtgccaccacgcccagctaattttgtatttttagtagagatggggtgtctccatgttggccaggctggtctcgaactcccgacctcacgtgatccacccacctcggcctcccaaagtgctgggattacaagcatgagctaccgtgcccagccagaatgtgatgaactttttaagattctcaaggtggtgtggaggatgtgaggagtggacaaggggagactctttgggggaaatattcctcttgaaaatattcaagatgagtggtagcaaccagggctggggctggcttgtagagataaagggcttaaagaaagttcatgaaagttgtgaaagctgtggaataaaatacgtcatttaaggatagttacaagtttttaaatttgaattaagatccctctta

SEQ ID NO: 83624 - DNA, 287 bp, Homo sapiens
ataggcgtgagccactatgcccagcctctattcttacttttcttattcccttcttgctcccttttatgagatagatagatatatatattctcccacctcagcctccctagtagctgggagtacaggtgcacaccaccacgctcagcttattttattttttttgtagagatggggtttctctgtgttgcccaggctggtcttcaactcctgggctcgagcaatctgtccaccttggcctcccaaagtgctaggattacaggcatgagctacttatgcctggtctttca

SEQ ID NO: 83625 - DNA, 518 bp, Homo sapiens
aaatgggtacttttgaagcatctgcactgaaaaatgctttccaaagaaaacatttgttagaacacacaaacgatttatttgggtacattgaagaacctaaacatttgattcagctgccagtatgtgctttgctggctaatgtttcttcagcatttccacattttcataggctagcggccaagttgtccgacagtctggtacctcttgggggtggaagtgggtgtgtatatgtggagctggtagcactagcatgctcctgtatgtcgccagttggcatatggtagaactggcagaagctggccccgccaacctggaagcatatagatactaacaagcttcttcagcctgcccaaaatggctcgaggaagctcactcagatcctctgtgacactgatcccaggaagtcagaactcttagagcagttttctcagctatgtcggatctgaggtaatcaagacagtacatctgaactggagtatgccatcattgcactaagacatattgtgattaaaaaaaaa

SEQ ID NO: 83626 - DNA, 705 bp, Homo sapiens
ttttatttttcatggttaatcctgggaactatattttaacttcagtggcttgtttccaccaagttcctgtacatcttctggtgggggagtggggttattagtttatagtatggttttagttctcatttcagtgtggaattagtcatttctgtataagggcaaaaggttctctgataatggtataaaactatagattgtttttggagtagcagtgacacttgtcaatttctaagatttataaggcttaaataccttgcacacatgttttttaaagtagattcaggggtcgggaaaactgaaaaatcactgtctttaagtacaagagaaaaatggaaatgcataaatattgaaaggttttacaatttgaaatgttctttgtggttttttcttttttaggtatgttttcataagcatatataaatttaaacatttttgatagcctctggccttaacttactgagcatgtgtcaccattgcacagctctttaaacagccgcttttaagatcaatgcaatttttcttttaattgaagattttgaaagattaagagttagtgagatgagctctctgcctcttttagtagaattgaatagtctggattgtggatattatttctctccgcccttttgtaaccctctttggctaatgtcctctgttcatccacgtattagccaagtgccagtaaccctgctttacattgggatt

SEQ ID NO: 83627 - DNA, 347 bp, Homo sapiens
gagaatcaacttgggaaaggcaaagtagatcccttttacttccctttggttccagtactgtttcatgtttttcattagaatgtggataaggaaatggggggagcgctcattaagctttgtgaatgacagcaaactggcaggagtattttaacacaaggtaactcctaacaagggccatatccattgaaaacggggtaaatgcacttgactaaaatggacattagaatgttaaatgtccttgtcaattgggagaaatagaaataaactgtaaaatccatgagagagaagtaacaacattgaaatgtaaaacaagtataaataaaaaagatgcacacattatatgtata

SEQ ID NO: 83628 - DNA, 416 bp, Homo sapiens
tctcacataaagactgtaagtccgtcccacattgcctggatttttaacagagcagtgattctcagtgtggtcctgggtcccacagccagcagcatccgcatcactggggaattcgtgagaaatgcacattctcaggcctgttggcctcctggagaggaggctctggggtggggcccagccatcggcatttaacaaaccctccaagggacccgacacacacacctttgagaaccaggatggaaaacatgctttttcaacacacattccctatctctgcacagcagggggactggatattctcccactctgcagatgaaaacactaaagcccagagaggttaagggatttgcctaaagtcaatcacctgcccctcccacactacacacttcagaaatttacctgagggggggtttcag

SEQ ID NO: 83629 - DNA, 699 bp, Homo sapiens
ggaaaaatggctaccaggggctgcagaatgatattttctttgtctagaaactacaacagagagaagtctgtctcccaatgtcagcatttgatttcaagggcaactctggctgtaggtatgaatgaatgacagggtgttgctctgtgtctcaggctggagtgcggtggcatgatcatggctcactgctccagctcagttttggttatgtagctatcctgtgtttctaggagtaggggttgtgccatagtagacacccagctagagctgcacggacttggggaggaattcccaggcaaagggtgactgtttccaggagaagggaaattggaaagtgctttgagctgattttaaaaagaatagttacatggacccttacctcataccatacataagaattaattcaaagtggaaccaagaatgaaatataagaggtaaaactatacaactctgggaggaaagcatagggacagctcttcatgaccttgtatttggcagtggtttcttacataagacaccaaaagcacagcaacaaaagaaaaaatagataaattagacttaatcaaaattaaaaacttttgtgcctcaaaagatacctatcaataagtgaaaacaaaaccaacagaatgattaaatatttgcaagccctatatctgataagggcttatgtctagaatagataaagacatcttagaactgtac

SEQ ID NO: 83630 - DNA, 314 bp, Homo sapiens
tttcttataaagacccttatgatgacacttggcctacccggataatccaggggcatctcccccatttcaacatcttcaagttcatcacatctgcaaagtgccttctgccacatttccaggttcagggattaggatgtaaacatctttgaggagctgttattctgcctgtctcctatgttttcttctagaagctttctatttttagattttacatttagatctctgtttcatctcaagtgaatttttgtgtattgtgtgaagcaggggataaggtttattttttctgtatctttttttttttttttttttttttt

SEQ ID NO: 83631 - DNA, 359 bp, Homo sapiens
acctccgactcatacatgctttcagtaagacccagtgagctaataaggattttgtgttaaatggtgagtctgtgaagatgcctttgcttctgcatttaagacagagagaagactttctgcatggatgtatgttttaacacttatgataaattatcggaaagagtggagtgagcccagaccaggagataatttacaatacatataaacaaagatccagcatcagaatgtacaaaataattcctacgaatcaactagaaaaagacaaataaccaaagcaaaaaaaatagcaaaggatataaaaaggaaactggaatgactcaaacatatgttcaacccctaatattcaaataaatataaac

SEQ ID NO: 83632 - DNA, 650 bp, Homo sapiens
gtggcctgggattgggagggccatcattttcatcccctacccccactccagggaagagtgtgaggcctgggctggcctgggctttgctgggcactttcataagctcctaagcttttctttgtgtcttaatggctgttactttggtatatgccttcctgggttcatcagactagtgtttcttgaacttaatctcctcccagacccacctgcacttgaagtaacacacatacaactcacctgggagcatgggaggacttcctaggccacgcctgatcaaaccagaggacagcaggaggaatcagggaatgtttcctagaggagctggaacttgacagaaagctgggagggatcaggaagaaagaactatctgcgaaaggcataaaaggagaaagggaaaggcaagattcaggtcagttatattcaacaagtgtttgttgaacatgtcctttgagccctctgtgaagccctgaagccctagagggagaagcttgacaaaggcaaggaaagaatcttctgccatcaccctaacattgccaccttgaaaagcttcgatggcagaagacttgataatgcaaaatacttaagggataacaggcagtagggtaaaatccggcacctgactcctaacaggatgctcatttggaagagga

SEQ ID NO: 83633 - DNA, 332 bp, Homo sapiens
ttttgacaggaaatggaggtgtattttaatataggcagcgagggagagggaggtggcaaggatgactcctagttcctgacttgctcgcggatgtttgtcgaatgaatgatccagtgaccccaaggcagaagtatctcagagagatccccccactcccctccccgcacccgtcaccacgctgccttcggagctctgaccgtaagggggtggatggaaggcaggaggaagggaatggccacggagtcttggtccaggagctgctagactggacacttctagcactggtctgagccaggagacgctgcgaaaagagggcaaacgtttctcctctc

SEQ ID NO: 83634 - DNA, 230 bp, Homo sapiens
taatggagtcaggttgatttttctatacttccgttatgttatgtatgattatgaatggcaaattaacatgaggtatagatctttttgtgtattatgttagaacatctatgcaaaacaaatattttggtaggtaggtaagcactcaggccttctcaattttcaccataattcaaaaaaatcattttagactatgactaatttcattttctccaacttataagagagcaaaa

SEQ ID NO: 83635 - DNA, 116 bp, Homo sapiens
ctggcagcagcaggacagggaaagggtgagacattggcatgttttggagatattcaggaacaagactccagaattcagtgccagccgaattattttttcttaggtatttactatgc

SEQ ID NO: 83636 - DNA, 283 bp, Homo sapiens
ctgatagggtagtgggtggaagatgatgggaatagaaagatcttgaacattgggtggttccaatgttccacgtgaggatgaaagggagccgaaagcaagccttgcctccctcactactgtcttgaagtgactacaatcagagatgacagtcccaattcctaggctatcatttatgaagcatggagctctgatgggttacctagcaggcacagcaatgtagtccatctttaatgtgagtggcaggaaagtcaaccgcagccccccagagccatcgaccactggg

SEQ ID NO: 83637 - DNA, 239 bp, Homo sapiens
aagaggggtgttcctcttgggcggccctgagccaccctcggcgggtcccaggagcctgcgaggcagctcccgggagaatgggggtcctgaggataggctgggggtcccgggagcgccgaaacagcgggcccacctgtagtcctgcctgccgtgagggtaccccgctcccgggccagccgagccctgccgctgtctggcgccccctccgcctggggaagccccgaaggcagtttccgccc

SEQ ID NO: 83638 - DNA, 345 bp, Homo sapiens
ggcctggtgtttggctgaggtgcactaggacccctggccgtggtgtactggatggcatcagttctgatgggtcagatgtccattctaacaggttggtgctggagagggagcagttgttaaatatctttactatctcccctgctccggacacctagatgcccaaatatacagcacgtagtatcgaggcaggcccttttgattgacatcagaatcaggtttgcaatggaataggagctttccttcctcctgtcactttagccccaggctccacctcagagtctggaatgctcatacctatggcaggtgaccttgtgtaacaggttggggttaatgccattctgtcct

SEQ ID NO: 83639 - DNA, 474 bp, Homo sapiens
tcatgtcaccgggtcacaggaggattgtttttaatatctgagtttttaaagcaagggactgtaagtttactattctttaatactaattttttaaaaatgcatacttagtaacagtacaccacataatcctaacacaaattatccaattaaattctaaaccttaaatttttttcatttttttttgttttttgagacagggttttgctccgtcactcaggctggagtgcaggggcacaaccatggctcactgcattctccacctcttgagctcaagcgatcctcccatctcattttttcagagatgggggtctcactattttgcctaggctggttgagacttttcaacagaagcaactgataccacaaaactattaaataatttcttcataaactgaggccagcacggcggctcactcctgtaatcccagcactttgggaggccgaggtgggaagattacttgaggcctgagacca

SEQ ID NO: 83640 - DNA, 526 bp, Homo sapiens
ttagtagaaatagggtttcaccatgttagccaggctggtcttgaactcctgacctcaggtgatcacccgcctaggcctcccaaagtgctgggattacaggcgtgagccaccgcgcccggccaaaaatgacatttctttaaagtgtatctctccggtttcacaatgaatgatggcagcaactggtaaaccaaataggaggttctaacagtccaacaagaaatgataggggcctgaactaatgatgacataaaagacacagaatgtaacgtcacaggaatttgtggatacttccaaaccagggggaaaagagggcggtaggagtcatcctaaaattcccaggtttctcactgggataagaaagtgctgtgctgctgatgccactgagatggcgaacttaggcagaagttattatttgcttgtaaaatatccaaaagaaaaaatacatttaagagtggctttttcccaccttctgggccattcaatattactgctgtctactatagctcatatctttttctccctacta

SEQ ID NO: 83641 - DNA, 356 bp, Homo sapiens
attacatataacaatgcagcatttgatctaattgaaaagtagctactggaagtgaaggtggttttccataagaagaatagctggtattatcaggaataacagtgaggtcacagggcattgagttgagtcagtttgttctgacacttacatatttgattttcatgcctcttttattctaagatgcataatccatgtcacccaacatggagctggactaccaactactcttcttttgaaagctatgctaatttgagacattcttaccgggcgcacggtgtgggtatgggttacagagaatgtggatgatctatttctcaggaaacctctgaaaaggaggacagtcacccatctgtctg

SEQ ID NO: 83642 - DNA, 217 bp, Homo sapiens
ccatgcaaaaaccaatcaaaagaagctaccgtaacaacagtaatatcaaataagacagatgtctcaacaaagaaaattaccaggaaaaaagaggaacaaggcccaggcaccgtggctcacacttgtaatcccagcactttgggagcccagcagagatcacctgaggtcaggagttcgagactagcctggccaacatggtgaaaccccgtctctacta

SEQ ID NO: 83643 - DNA, 413 bp, Homo sapiens
ggtggggtgttactatattgcttagaatgatctcgtactcctgggttcaagtgaccctcctatgttggcctcccaaagtgttgggagtacaggcatgagccaccatgtctgggtgcattaagcattcttgaggagtctctgacccagttcctctccagtgtagtactggggagggcagaatttttaacagcatagccagcattctgctgggaagtgagaagccagtgcatctttcttatgggcactccaatctctacaagcaatttcctaaagctctgctcacttgacactgtagatggagagaaagcaacccctcctactttcaaaggaagaaaaggtaaaaaccctttcaactgtgggcgctatgctccccacaaggccaacgatctcagtgtttgtctttctctactcat

SEQ ID NO: 83644 - DNA, 433 bp, Homo sapiens
agagggctctgtgacaccctggtctcaccgccactcttccaaagtcgcagaggctttagcagagatgggcccagcctctctgagtcataggcttctgcacacgggagctgtctttagagggagggtggaatttcatcagccacccacatgggggagttgagggcaagaattaggagcaaagatgggaaggggtctgggaggaatggccagtgatcccctttgacaagtgggcaggaaacgggggctaggtcaaagttgagtggaagacctggagggagacgggaaggtctctgtaggcacagttcagacaggagggaggtgtgagccagggcacatgccggtggccgtctggcaggatttgggacatgctggagcagggacagcggctcatcaggggccattgccctcatccaggccagagtgtcacaagccc

SEQ ID NO: 83645 - DNA, 532 bp, Homo sapiens
gccgcgcgctcccgggtccgcagcccccaccgccgacagggccccgcagggcgcagcggggctgggaaggggaagtcggccaggcctgcgcggcttcccaggctgtcccggcgcagaggcggccccgggcctccttggaaaggaaccgtccccgtgtatcccggcggggtgagcacaaggcgggtgctgtccgactttcaacagtcgcagcgagaatgtcctaggaaactaaacaactttttaaactgtctttccaaagaatcaggatgctgagaagtcaaccagctcctggaggactgaccggaagggcacctggcctcggcccgggcggctccccattcgttcctcactgcgcccctcatccccactcccccggccctgcagggtgccccgtggtgctgaccatggcattgcctggacccatcaactggtaaaacacacgagccttagcagagatacgatttcattcctcaccagaggcccttgagattttaggattctatcaacgctagtaaaggaactacttgaacac

SEQ ID NO: 83646 - DNA, 434 bp, Homo sapiens
acagaccagacaatggtgagaactgaagtgagcttttcctttgtcccatgggtaatcaccaagtttggccagaagtatgaatgacaggtattcatgagtgttaactccctcctcccaagcaattcttggtactcaacctaggagtttgttccccatctccccgagatgagcatatcctgctgtattccagccagaaagtaactgagcatttcagttctgctatttgcctagttttctgggtgggaaagacagacacattaaggtttggccaggcacggtgggaggattgcttgaggccaggaggttgagtttgagattagcctgggcaacatagagagacctcatctctacaaacaacaaaaaaatagaaaaaaattagtgggcatactggcacacacctgtagtcccatctactttgggaatttgaagcagga

SEQ ID NO: 83647 - DNA, 218 bp, Homo sapiens
taagcccagctattggggaagctgaggtgggagaatcgcttgaaccgggaaggcagaggtgagttgagatcacgccactgcaccccagcctgggcgacagagagactccatctcaaaaaaaagaaaaagacacagagcaatggggaagatagagaatagaatttcacatctggggggaaatgtgtccatctaactgcaaaatattaagatagccttta

SEQ ID NO: 83648 - DNA, 916 bp, Homo sapiens
gttcagtgctatccaagtgactcccccgggagaggacaactggaaatttatgcctggtgtcttcctggactccgacctatgcacctttttccttggatgattttaacctgtctccttttgctgcaatgaaccataacccatgagtatatcagcttttctaatttttgtgagtccctcaagtgaattatcaaacctaaggtagttttgggacccccatcacagagagtcaaacaggggcagggcaagaagagctgcttttcctggaaggctaatgagtctgaacttcgccctggaggtaatcgttatagtaactccaggctctaacctggagctgacatgataaggtcaaatgtacacctctagaagacttccgactgcagaggggaatggatgggggagctgagggaggagagctgaagcaggaagaccatggcctggaaagagatggctgaaccagtccaggtggcgaggagtccatgtcagctgccgtcatccacaccacagatcagacatggcaaagagtggccaggccttctgagtgaaggtgatccaacctgtcaccaagcctaagggcaaatcctggctgtgctgtgatggctccaacaaccccaaacagcagcgcagaggctgcagccaccctcggaggcaacactgggaaacgctcattagcagccttccattgctcacccgccccatcccacctctgtgcatcccagatcatcagcgaagtgcacagctggcttccatcctcggagccttcctccttcatttgcctattcaacagttacaaaggcctgagttgcaaaggggcttacaacccattccacccagaagaaagagaactgagactgagcaagacagagaataggtggaaggggagatgaaaccaagcaatctctagatcccaaatggggac

SEQ ID NO: 83649 - DNA, 387 bp, Homo sapiens
tgccgccctgcctgagagctgcgtcgccctaggaatcactcccgccacctcgggccgccgggtccccccgctggctccagtcttacctgacggctgtctctgtcctctggagaatgctgagcgaaggtcaggtgtccctaaggtctgaagaactgaaaggctggaatgtctcctggtgggcaagtgcggggtcaggggtcacagccagcctggaggcctccttccctaactccttgtgggagccacctggagactcaggaatgagcctgcctggggcatgggtcaccgtgcaggaccccagacacacctgggttgaaaccctactgtctccaagcttgggggtcacttccattcttgaacctcagctgccacacctggggggttaca

SEQ ID NO: 83650 - DNA, 599 bp, Homo sapiens
tcacagaggcagcggcggccatgttggaagagggcaaagagccgccaggacccgcccaccccgcggatgcgctggatctcgagggcgcagaactcggagtggcgaggagaagcgggagggcagattgagcgcgcgtggggctcgtgagcctggggactgggagtaaaaacaactacctcaagcaggaggctcagtccccgccaacactcgctgggataactctcgataggacggaggaggagccccccagtgggaccctcctcagtgcaatggatgggaccctcctcagtgcaatggatgggaccctcctcagtgcgatggatgtgagcagcccaggccctaggggagcagagagtgttccgctgaagaaaccctctgctggtcctttgagcgcccccagataagagagacagggtctctctctgtcgcccaggctggagtgcagtggcgcgatcccggctcactgcagcagcctcaacttccagagctcaagggatcctcccaccccaacctcccgagtagctgagactacacgaatgtaccaccactcccggctaagttttgtgtttctcgtagaaacgtggtttcgccatgttgcc

SEQ ID NO: 83651 - DNA, 417 bp, Homo sapiens
gctctgggtggatgtgtgtgtgtgcacacatatgtatgtatgtggatgactaaaagtgcatgctctcctctcctttcccagcttcctctccagcacagcaacttgtgttcgtatgcacacacatgcacactctctctcatgggcacatgcatacccacacacactcgtgtacatttccaggaaatggaattacatttcagatagattcagattccaacggcagtcttctaaacacttttatgcaagcagccattcaaggagaccctcagcaaaatataaatgacgaggagctgccctcatggggccctgtggaaagcactttgcagtccagccttgggttttgtggtcacagagttcacctgtggatgtttgtagcacactctccttgtcttgtctgctctgggtcaccaggcacag

SEQ ID NO: 83652 - DNA, 624 bp, Homo sapiens
cagcagagagcagggagtagggagagtgctggctccagatgcttctatccagggagatgctgggaagtggcccagagtcaagggcttaggaggttgcaaacctcactatgccaagagctcggtccctgatccaccccatccccttccacatctccctgactgtccttctttacatttgctgggcagagtgccacctgtgtgcaccagccctccctgcctgcacaagccacactgagaaagccgttgcctccagctcatggagagaaacaccttctcagctgccacgtcatgagcaagtttgcttcgggaccacctgggaaaccaggagtagaaggggtaaactcttcctcatctgccacaggcctgccttgcctcaggccacgtcaccttaccccagccatgttgccagggcatgaggactaagatgcttgccctgccaagcccggaggggatgagcagcctcagctggtgccgccacagacagcacaccacagaggtggctcagggaccttggtagatgggaatgtgagaatctattaaaataggcagggatctccggtcctctgtcaagaggcaatgctgacggctttttcctgctggcgtgcctctgcccaccagccttcc

SEQ ID NO: 83653 - DNA, 335 bp, Homo sapiens
tctgcacaaattgcttctaaatttctttcctcaaagaagaggtattccccctgctagtacatacatcaagcctaaccagaaatttggagtaaatcaaacagagggaggccgaggtctacctttcattatgcaaaaggggcttaaggaagcaagtgactgtaattaatattaaactggacaaaaatagccgtttattccttacaattgcttcaacactgccagcagtatacaaatagcccgttatcctagtcactggagatgacttcataaacagttttccctctgtatatataaacatacatcttctgctctgatttttaaaatgtctttatgct

SEQ ID NO: 83654 - DNA, 398 bp, Homo sapiens
atagtgtaaaattacctggactttcaagtctcagtaaatgttctacggaaatgtaaaacttgttcacaatagaaataagttgcaccatagtcatacaatcttttgaaacttggacattcactgtttagaggagattcaccctttaaacaagtttcacaaaagtagagtcaggcggatcacgaggtcaggagatcgagaccatcctggctaacgtggtgaaaccctgtctctactaaaaatacaaaaaattagccaggcgtggtggcaggcgcctgtagtcccagccactcaggaggctgaggcaggagaatggcgtgaacccgggaggtggagcttgcggtgagccgagattacgccattgcactccagcctgggcgacagagtgagactctgtctca

SEQ ID NO: 83655 - DNA, 304 bp, Homo sapiens
ttgatttaagttgaaccaatctaatagtcaagagactagttaagtcacaacttgaaaaaaaaaaaacagaaaaatgagaattaagttaggttgacaaagtgtgagaagaaaaaagggatataaaaagttctatttttttttaacttcttaaaatatctcatatttatctactttccactgtcaccaccacctagagtagggtgtctaatcttttggcttccctgggccacattggaagaagaattgtcttgggccacacataaaatacaataacaccaaccatagctgatgagctaaacaacaa

SEQ ID NO: 83656 - DNA, 753 bp, Homo sapiens
ctagagacaaggtgccctccgaccccttcttccaaatatactcttttgcctcttgtcttttattcccgtgtttgccccctttgttcagtccccctaggtccatgcaggttacatagtggtgccccaaacagtgacacaattgggttctcaacaagtggtgactcagaacagggacgccaaggatgccaacaagtggcgtctgaacacgggacttcgacgatgtgaacaaaaaagatctgctggagcagagaagctgaaattgacaaggcaaacggggaccccaggatgagtctgccggcagcatatataaggcagggactataggaaatgaaggtgaactcgtggagattttggagagaatttaatgaagaggctgtttaccaaggatctctctctgtctccgaggctggagtgcaatgttgcaatcagggctcactgcagcctcgacctcctgggctcaactgatcttcgtaccacagcctcatgagtaactgggactacagatagtatctcatgatatgaatggtcctggatttacttacacatcctcctttggatgagcaaaaagtaaatttttcacagtgatagacatttgtagtgctttttaaaggcactggttctggtggacactgagagacaatttttatttgctgcacgtggaaaggacaacaacatacctggacagaaatgcctcgaggatgtactgaaggcccctctcacttttcacaggtactgaagacagatttaacggac

SEQ ID NO: 83657 - DNA, 423 bp, Homo sapiens
ataagcaatctaatggtgtactcaagaactagaagagtaagaacaaaccaaatccaaaattagtagaaggaaagaaataacagatcacagaagaattaaacaaaatagagactaaaaacacaatagaaaaaaatctacaaaataaaaagttgttttttttgaaaagacaaatacaatcaataaaccacttggtaggataaccaagaaaaaaaaagggagaagaccaaaataaaatcagaaatgaaaaaaaagacatcacaactgataactacaaaaatacaaaagatcagaggcactaacaaactaaaaaacgtacaggaaatggatgagttcctggacacatacaacctatcaagatcaaatccagaagacgtagaaaatctgaagaaaacaataacaagttataagagattgcggtgttaa

SEQ ID NO: 83658 - DNA, 603 bp, Homo sapiens
cggtgatgggtagagaatggagaggagagagtgaggtggtaacactggaaaggtgacgtggtaaattcacacagtgaaggaggaggtgcacatacaagtggaggggtcccaggtgctcatggccatggtggggggaggccaggctggagagaagattcaggtgttggtcaataaaatgatgggccgggtgcggtggctcacccctgtaatcccagcactttgggaggccaaggcaggtggatcacttgaggccaggagtttgagaccagcctggccaacatgctgaaaccctgtctctactaaaaatacaaaaattagctgggcatccgggcctggtggttcacgcctctaatcccagcactttgggaggccgaggcggacagatcacaaggtcaggaattagagaccagcctgaccaacgtggtgaaccccatctctactgaaaataaaaaattagccgggtatggtggtgcctgcttgtaatcccagctactcagaaggctgaggcaggagaatcgcttgaacccgggaggtggaggttgcagtgagccaagatcacaccactgcgctccagcctgggcgacagagtgagactctgtctca

SEQ ID NO: 83659 - DNA, 705 bp, Homo sapiens
ggtatagccatataatggattacagctgttaaaaagaagggtggatgtgtgacataacaaaaatatattagaattgaagaccgggcacagtggctcatgtatcccaggactttgggaagctgaggctggcagatctcttgagcccaggagttggagaccagcctgggcaacataatgaaaccaagtcctacaaaatatacaaaaattagcaggggttggtggcatgcatctgtggtcccagctacttgggaggctgaggcaagaggattgcttgagccctggaggctgcagtgagccatgatagcaacactgcattctaccctgggtgacagagcgagaccctttcttaaataaaataatggaatgaaaaaaaatgtaagtacagcagcagtacaaggcatagcatcaacctacttttgttgaaaaaattttttttagtttgtatacatgtagaaatgcctgaagcaattatttgcagattacctctagataatttatatgcctgtttggtggtgttgtttggttttggggttaggttacactgtctttttggagacagagtctcgctcgggtcgccaggccgaagtgcggggggcgcaaatcatcagatcagcgggaacctccggctccgggggttcaagcagattccccgggctcgagactcccgaggggctggggactacaggccacgtgccaccaaaccca

SEQ ID NO: 83660 - DNA, 742 bp, Homo sapiens
aatacaatggcttctggtcaattcagtcataagatgtattcctggctggaaaattctgctatttggaatctacagttagacaagactgcatgttagactctgaagttaggcagggtcaccaccctggacaggtatggaatgtattcggtgttgaggagtttggacagtacagcagcagctgctctagagcataagcagatggtgaatgttcaacttgattacattgaccaaacggaattggataacaaactcgaaatagtttgagaaaaaagcacacgtataatgcttagagatgtaaaagccattttgcaagaatgagaatgagtgctacatgctaaggaaagtggaatggaaagttaagaacagttaagaatgaggtgaagactagaaaagggaaaattgtctttgttgaagagcgcttgtctcctgacagttactcagtgatgcaaagctaaaaagagcactgtgctcatggtggaaaataattcccaggacttgacagggaagaatgtactcattccacgccccgggcagaagtctgctgagacaaacagaagaaagatagttagtgagcaaattcatcaagaccaatatcatgtatttctccccctggcctgatggctgatttgcactcctcctgtaagcaacaaaactgcaaaaccagtgctacaaaacagaagcacctgtaagtccgtgggagcacatctttgctcaacaagagatcctgacaactaacaactaa

SEQ ID NO: 83661 - DNA, 538 bp, Homo sapiens
agattgggcccactcagataatgaaaagatggttttgatattgaatttgttaatcgtcttttagatgtttcttcatctgtatcttttaaaatacacctacctcatactttgtgtgaagtttaaatgaaatatctttgctttatttgggatgctgtggcatttcctttttttgaaagttgtgtttaatcactaatattgcaacaattctatgtgttaatgattctctaggtaaaagaaatatttttgacatcgtaggctaaacaggcatttgtaaattagttgaggaacattttttgtttcagttgggatatatattgtaagtatcctaaaaatctcagaatgaacctgttttgtaaactggactgattgtacagtaaaataccaagtaggtaatgatatccaaataccagcttaaatcctaacctataatgggtgctgaaaagtgtttactgaaataaaagtaactaaatagtgtgatgtcttttaagaattttagtactctataatcactaacctagaagcctctttattataagat

SEQ ID NO: 83662 - DNA, 404 bp, Homo sapiens
tctttccttttctttttcttttctttcttcttttgtctctctctctctctctctctctaagtcccactctgttgtctaggctcgagcacagtggtgcaatcacacctcactgcaacctcaatctcctgggttcaatgaatcctcccacctcagcctctcaagcagctgggattacaggtgcatgccaccatgcctggctaatttacttttgtgtgtgtgtggttttcttttgttgttgttattttttgtagagattggattttgccatgtttcccaggctggtgatgattattttcttctagtgtttgtttgtgccacctgaacactgaagtggtgtaccacctgatcctcaggtcttcttgtttccctccttcctcctggtggtgaacaacactttttctgtg

SEQ ID NO: 83663 - DNA, 820 bp, Homo sapiens
ctgctttcagaggagtggctggtagactgatggctcttttattagtgaagttcagataagcctgtgatccactccacggcaacccgagggagaggtcaagtcacacagagctctgtgtcaccccctgacagtttcctcaccacagtcagaatggcacttgtgacagacactggagtttctctgctatctaattaaggttccattaacttaactaggttaaccatatttgctttctattatggccaacctccaggccagaatttcaataattatcatatattgttgattttttttttccacaaacgctttccggttgccactatccttcagcaattgggcaagccttctgtctatgtgacaaaattttttttttttaaaaaaaggatacaatcaaactgcgttcattgattggcagatatattctagctgctaaatgagctgctggggtcctccagataagcccctgcattctggagcttgccctgcagtgggtgacatggacatgttcagcagagctgtgtaatgactgcggccatgtgccggtagattccaagtgctgtgttatcacacatgaggaaaaactgggcagtcatggaaccattactggaagaggaaagggctagagtgaatccaaaatttcaactagagattggccatgggaagagagaggaagaagatattgcaggaagaaaggtagtgacttgaacacatttggaaaagtgcatttattcaacaagatccaccagtgcaggaagaagagagagagagagagagatgatgtcagaccatgaatgtcccaaatagaaaaattaaaaaggga

SEQ ID NO: 83664 - DNA, 1463 bp, Homo sapiens
ggaatctaacactcaccgaggggcggagtagcttccggaaagggtactgcatttcccgtttctacctccactgcacccgcttattgcgtcttgctcctgggtcacagagcctaaaacgacacacccaacacgcccgccggagttacagctaaaggaaggacaggggaagcaatgaaatgccgagggcggagccaagagcgacactgggggagcaggaaaaggcggggcttccgcttggggcatggaggctgtacctcttacgtcacttccgtaaacaaacggagctgcggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaaaatgccattccagtgagtaaaagcacagggttttcaaatcctgcatcacagtcaacttcacagcgaccaaagttaaaaagagtgatgaaagaaaagaccaaacctcagggtggagagggcaaaggcgctcagtcaactccgatccagcactccttcctcactgatgtctcagatgttcaggagatggagagagggctgctcagtcttttgaatgatttccactctgggggaatgcaggagaaattagctcgcttgaatttggagctctatggggagttagaggaacttcctgaggataagagaaaaacagccagtgactccaatctggataggcttctgtcagatttagaagaattgaattcttccatacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaagtaattaaagtgcaagttcaatgatcgttttcacttactgcttttagtaaatgtgactcgctgtaattcgccataactggaggcctaggccttgttgaaggcttcatcaggaaatgtgacgcagagattgtgctgctgtgcttcatattgttgccttatgggattatacttgaaatgcattgtgctgatgttcttgacagggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgttttaaattaa

SEQ ID NO: 83665 - DNA, 1085 bp, Homo sapiens
aaaaataactctgggccaggtgtggtggctcgcacctgtaatcccagcactttgggaggccgaggcaggaaggttgcttgaggccaggagttcaagaccagcctgggcaacatagccagactcctcccccatctctaacaaagaatagaaaaattagccaggtatgttggcacatgcctttgggaggctgaggtgggaggattgcttgagcccaggagttcaaggctacagtgaagtatgatcgtattactgcattccagccagggaaacaaagtgagtccttatctctaaaatttaaaaaaaaaaaagtcttcaaattctagacagagtataatttactacatttaaaagttgtcttaccacatctgagtgtctcagtagcaacacaagagcttttcctttgaacatatctcttttttaaataccgctttctctttgctcctgaatgtaattttcagaaatgtaaaagaagtaccccttatagaatgaaaatcttcttaactgattaattcagacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaagtaattaaagtgcaagttcaatgatcgttttcacttactgcttttagtaaatgtgactcgctgtaattcgccataactggaggcctaggccttgttgaaggcttcatcaggaaatgtgacgcagagattgtgctgctgtgcttcatattgttgccttatgggattatacttgaaatgcattgtgctgatgttcttgacagggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgttttaaattaa

SEQ ID NO: 83666 - DNA, 1317 bp, Homo sapiens
ggaatctaacactcaccgaggggcggagtagcttccggaaagggtactgcatttcccgtttctacctccactgcacccgcttattgcgtcttgctcctgggtcacagagcctaaaacgacacacccaacacgcccgccggagttacagctaaaggaaggacaggggaagcaatgaaatgccgagggcggagccaagagcgacactgggggagcaggaaaaggcggggcttccgcttggggcatggaggctgtacctcttacgtcacttccgtaaacaaacggagctgcggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaaaatgccattccagtgagtaaaagcacagggttttcaaatcctgcatcacagtcaacttcacagcgaccaaagttaaaaagagtgatgaaagaaaagaccaaacctcagggtggagagggcaaaggcgctcagtcaactccgatccagcactccttcctcactgatgtctcagatgttcaggagatggagagagggctgctcagtcttttgaatgatttccactctggaaaacttcaagcatttggaaatgaatgttccattgaacagatggaacatgttcggggaatgcaggagaaattagctcgcttgaatttggagctctatggggagttagaggaacttcctgaggataagagaaaaacagccagtgactccaatctggataggcttctgtcagatttagaagaattgaattcttccatacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaaggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgttttaaattaa

SEQ ID NO: 83667 - DNA, 1517 bp, Homo sapiens
ggaatctaacactcaccgaggggcggagtagcttccggaaagggtactgcatttcccgtttctacctccactgcacccgcttattgcgtcttgctcctgggtcacagagcctaaaacgacacacccaacacgcccgccggagttacagctaaaggaaggacaggggaagcaatgaaatgccgagggcggagccaagagcgacactgggggagcaggaaaaggcggggcttccgcttggggcatggaggctgtacctcttacgtcacttccgtaaacaaacggagctgcggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaaaatgccattccagtgagtaaaagcacagggttttcaaatcctgcatcacagtcaacttcacagcgaccaaagttaaaaagagtgatgaaagaaaagaccaaacctcagggtggagagggcaaaggcgctcagtcaactccgatccagcactccttcctcactgatgtctcagatgttcaggagatggagagagggctgctcagtcttttgaatgatttccactctggaaaacttcaagcatttggaaatgaatgttccattgaacagatggaacatgttcggggaatgcaggagaaattagctcgcttgaatttggagctctatggggagttagaggaacttcctgaggataagagaaaaacagccagtgactccaatctggataggcttctgtcagatttagaagaattgaattcttccatacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaagtaattaaagtgcaagttcaatgatcgttttcacttactgcttttagtaaatgtgactcgctgtaattcgccataactggaggcctaggccttgttgaaggcttcatcaggaaatgtgacgcagagattgtgctgctgtgcttcatattgttgccttatgggattatacttgaaatgcattgtgctgatgttcttgacagggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgttttaaattaa

SEQ ID NO: 83668 - DNA, 370 bp, Homo sapiens
ataaaacacaaagcatggtcagttactcttactgtatcagccatgtaaactacaatagtaaagagcgagatggaagattaggagaacgtctactcaacaagaatttggcagccatccgtggacaaaagttcccttgagggagatttgggacctggatagaagactgcaaaactctagtggagcccaagactgaggagggctgttttgactggcaggctgcacctaggtggcaggctcactgaccatggtcccagctacaaacccagaaattgcttcattgccctgtggacttggtcctgcctctagaaccatctgccaagaaatccaggaggaatcacattcacctgtacctctggtgacaagcccacag

SEQ ID NO: 83669 - DNA, 539 bp, Homo sapiens
tggtgatctagaggatccgttggatgaggaacgtcacttcatgtgaggccccagtcacctgcttaagcccttttgcacttattgggcaggtaaacaagagtttgcatataaatcggggcaccttagctctaggatcaataggaagcagagtcacaatgcctaaggtaatgagaacggttaataactcagatgattaaatcctccttttccaggatcatggtgtagaccaagagtacctgcagtcacgccaggaatgacgtccattcttacctcacccatctgtttttgcacaatttgcatttagatgtagcaaactaaatttcctttactcattccttccttgtttttaagctctacttaattctgacaaggttcacaatctaatgatggaaaggacaggcttaatggacaaaaggggatgtcagcctcccagaaacaaatattcttttgttgagatctcccacacaaaatgtggtcagtatgtcagcctggaaatgttgaccttttcacagttgccattaatgggtcaagccagtggg

SEQ ID NO: 83670 - DNA, 778 bp, Homo sapiens
cagtctgtcattttgctttggcctccagctctagcaatgaataggtagggatgaagaaaaggttttctaccaaggataaaagaagaacagcaacttctctcggaccagtagccaaagacaaagatctaaactgtttccactctcctagctggccacctcatagacaggatatggctctatttgggacagataatcagaatttcttcttgcctttcctgcagaccagctcagtcccgctcagctcccgtaccttctaggcagaaatagtcttgtcacttcatgtgaggccccagtcacctgcttaagcccttttgcacttattgggcaggtaaacaagagtttgcatataaatcggggcaccttagctctaggatcaataggaagcagagtcacaatgcctaaggtaatgagaacggttaataactcagatgattaaatcctccttttccaggatcatggtgtagaccaagagtacctgcagtcacgccaggaatgacgtccattcttacctcacccatctgtttttgcacaatttgcatttagatgtagcaaactaaatttcctttactcattccttccttgtttttaagctctacttaattctgacaaggttcacaatctaatgatggaaaggacaggcttaatggacaaaaggggatgtcagcctcccagaaacaaatattcttttgttgagatctcccacacaaaatgtggtcagtatgtcagcctggaaatgttgaccttttcacagttgccattaatgggtcaagccagtggg

SEQ ID NO: 83671 - DNA, 670 bp, Homo sapiens
tcctgcaccatgatgtctgcactggttagttccttcttttgttggttcactggacttgccagcctctgaggccaggatgccatgtggagctatgctgcagtggtgtccagagaggctcttcactcctgtatgtcctgcagatggatgtgccctgggttgccatggtatccagggatgtcaatgctgccactgagtcctagttcttcagagtcaatccctctctttgggtatctcattctaaagttgaccttagttttgagagtcaatggattcttctctcagggacagtatgtccatcagccaacctcatgatattgaagcatatgagctagaatgcaatttattaataaaaaatgagaacagtatttgccaagaagaatgggcgtttattctttagccaacatttttcctctgtggatgagtcatggtgagaaatgtacatgagttttcaaactttcctagggatagaaactgcagctgggacaaagactccttgaattcagagctgtgctttgaaattcaaggagtcttcgtcccaatggcagtcaaattcaatttataacttagtaggcagttaagccatcagtggcatcgggttctagccaggcacttgattcccagagtgttgtctgggtacgagctcgatcgtatcaggcatgtgtcgtaggaa

SEQ ID NO: 83672 - DNA, 729 bp, Homo sapiens
gaacttcggaggatgttcatgtccaggagcagccccacgccctgtatggtcggtgtctagagcctcacagcaactaagaccaacccagctctcagaagaaggaatgtcaaaatgtcatgttcaattttacattcagtgcctggaatcttttcttcacaattgaaatgaaatgtgctgaaggaggtgaatccatgcattaatcttcagctcacaaaggaaatactacataagaagcaaggtaagtgcctgctctcctcccagaacgcctcctggggcggctgaacaaacgttttgctgcacaaagcctagcgttggattaaaggggtggtttaattcattcctaggaacacgcaagagatctacagctctgatctccaggatagtgaaatgaggtggtgaatgataagggtataatttagccagctcagtgaataaataatcattgcaaatgaagcagtagcaccaggtaattaaattaatctgtctcatagacatgattccctgactctccactgacaaagttgcctttctagatttgacttttactgttgggccttctttggatgctgaaagaagttcttagcttcctattctcagagggttcccctggaaagggcatgaagaataatagacaaacattccattcttcaccccgtgctgccagccccatgaggtccaaagggtgggatgtagacaccatcacagtttcatgtttttataccttccctt

SEQ ID NO: 83673 - DNA, 691 bp, Homo sapiens
taaattcaaataggatacttaacctctctgttcatccttcctcttgtacaaaaaaatacaggaaataattgataaccgctagtcaatcggttattgcaaagagtaagtgagataacgtctgagaacatacatgcaagcacctagcagagtgttggccccaggctccttcctgcggcttccctgctcccccagcttccaccctccccctgccctttatagcttccaaagttcatcctggttcattttgaatcaggcaacgaagctgttccagtagcttccattgtgatgggaggagggttagaaataagaaatgaaggagtctaagcagcactatctaactcctggtcaacagcaccaccctgggaaagtcatttggcttctgtgaggctcagtgtcctcatctgtcaagtggaaatagtggtaatgcccatcctgccaaattcccctggtgttatgagatttaagtcaaagtgtttatgggaaagtactttggagaataatataagttcttgccatgtttagaggttttctagtctataattttttttagaagagtgcctatgatgaaggatggatgaagtgagcttaaatgctgggctttcaaaaccaatgtaaggcctttctgaaatcctgctttgtaaagcatacacttatctaacaagaaagaaacagggtgataggtggctggaaa

SEQ ID NO: 83674 - DNA, 406 bp, Homo sapiens
gggatgctgaagccggagaatcgcttgaacccgggaggcggaggttgcagtgacctcacattgtaccacttgcactctagcctgggtaacagagtaagactacgtcttaaaacaaacaaacaaaccaaagaaattatacaggtttgcctctgaagaagagaagtttgaataagcacaatagtattttctagatttagtgtaattaggtaaatatatcaatttataaaaagtacgaaaccacatttttgacacgtttattatatttaaaatatagcgcaataaaataaggttaggaaatgattgcatattactctctgagaggaagaatgttatctgttggtagaattaataaagttactcatttcttataagaagtaaagatatattggccgggtgcggtggctca

SEQ ID NO: 83675 - DNA, 863 bp, Homo sapiens
tgatgtccctagacttctcagtggcaacaactcatccattcaggagctccatgtaaccactggttcagagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggacgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaagggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaaaggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatatgcccattaaatttgataagatcctgtataacgaattcaaccattatgatacagcagcggggaaattcacgtgccacattgctggggtctattacttcacctaccacatcactgttttctcca

SEQ ID NO: 83676 - DNA, 952 bp, Homo sapiens
  misc_feature (23)..(23): n is a, c, g, or t
tttcagaactgcatcttatcatnttccgaataaagcacaaagtgctcaaaatcagagtttaatctcttcctctaatattcgactatcttcggtagcattcatgtatttttagttaacataacgattggtttagttttggcttatttaaagcattttacacttgctgtttcagatgtcagatgtcccctgtgagcttcttccttgaggcagcctgctctataggacaggtgagcccagcgggagccagcccactgctgacccaaaccctctagtccttgtcacaaaaagaggctgggacctgatggtggttctcttcctgacttttcctggtggtccttctgacttggagtggcctggcaatttcggtggcgtgacagccggaatgctgccactaaaattcctctctgggcaccatgagcggctgacagggcacgcggagaaaacgattcgcttctcccaggattggtggagcgaccgctgttggacgaatgtggtcgtccctggatgtctgagcaaagagacactgccatggcggccgccggtcagcgtataaggtctgttagggagacccgaagccctgcaccaggaacgcagtttggctcgcccagcccaccctgcagggctggctctccaggcgctgggtccggggagaagaggacagctgccccgccgcaccgcgcatccttccatccactgtggtacatggcgctgccccggtctccaacgtcgcgccacaccttcacggtctcacccggaagtcgaagcccagagacggtgccggccgcacccaatcactgctctgccgctccgacttccgctacggactcgcccagcctcctgggagaaacgctgcagtgcttggggtgctgaagccacttgagagccttgtgttctgtgagaaggttgcattctgaaggaacctcagctgtttgctttgctcttctgccaccca

SEQ ID NO: 83677 - DNA, 821 bp, Homo sapiens
ccgtctctcataccctatataacactaaaacaacacaccacccctctatataggtctgttgacttcttccttgaggcagcctgctctataggacaggtgagcccagcgggagccagcccactgctgacccaaaccctctagtccttgtcacaaaaagaggctgggacctgatggtggttctcttcctgacttttcctggtggtccttctgacttggagtggcctggcaatttcggtggcgtgacagccggaatgctgccactaaaattcctctctgggcaccatgagcggctgacagggcacgcggagaaaacgattcgcttctcccaggattggtggagcgaccgctgttggacgaatgtggtcgtccctggatgtctgagcaaagagacactgccatggcggccgccggtcagcgtataaggtctgttagggagacccgaagccctgcaccaggaacgcagtttggctcgcccagcccaccctgcagggctggctctccaggcgctgggtccggggagaagaggacagctgccccgccgcaccgcgcatccttccatccactgtggtacatggcgctgccccggtctccaacgtcgcgccacaccttcacggtctcacccggaagtcgaagcccagagacggtgccggccgcacccaatcactgctctgccgctccgacttccgctacggactcgcccagcctcctgggagaaacgctgcagtgcttggggtgctgaagccacttgagagccttgtgttctgtgagaaggttgcattctgaaggaacctcagctgtttgctttgctcttctgccaccca

SEQ ID NO: 83678 - DNA, 195 bp, Homo sapiens
tatgtatggtattcgtgcttacacataaaaagagtattatattttttttcacctcacaagaagcagtttttatctgcttggagaatgcatgatttaacaacagtgaaagaggtaaccctttagcagggtaagattaggctggatcacagtagctcccacctgtaatcccagcactttgggaggctgaggcgggtg

SEQ ID NO: 83679 - DNA, 280 bp, Homo sapiens
ggggcttagagggcatggaatggaaggaggacctacttctgaaagcctaggcatgcccactgcagaggggccagagggaaggaaggaagaaaggaattcatgcctttggcatttcctgcctccccaagcactgcaggagtggtttgccgggaaggctggtgttagaccaaaacctgcacctctgggagtcaacaaagagagcctggagaggctggaagggcagctggaagatcccatctctggaatctttgcaaaagaaggacctacctgtagacacaca

SEQ ID NO: 83680 - DNA, 712 bp, Homo sapiens
acatagatactgggtgaggaaggagccctaaattgcttgaaaaattgaatgctctttgggcaaagcaggaagccttgctatggaagagcatcatttgaacataaatcagagtctcagtacaaacagagtgctcaggacatcaagatggttaaccagagagcctggccagaatatctgcggtggagagaaacgatcttgttgggagaaggatgacaataattggggacttagaataaaggctaaaaatgattcaaagagaatgcaaaaagaatcaggcacacatcctttactctgttgtgcaaatctcaccttactgtgtgtttgtattctattcctccacaatctttattttattttatttttatgttcacagagatttgttggtgccaactaaatgagcccaacagccagtgacaacagaactgcactaaaaaaagtccctcatcagctcttgagagcaggttccttaaaggtgaacaatattccacatacaaggactttttcagcaccatgcattagaaatggaagtgaatgtttattattttttgtataagttggttgatacggcttttcagcttccctcagtatcattatccaaattttgtagatgacactaaagctcagaggagttaaaccattttcctcaaatcacatagctttaaataggaaaaccagatatgaaaagcagatttttttctaaattaaaaaaaaa

SEQ ID NO: 83681 - DNA, 350 bp, Homo sapiens
ggagtggcaggcaatcctgcctggatgctgctgtggggcttcatggagtttgcccctgcctgtgctaaagcatctagctggttccagcacccactcacctgtgtgctccctcctgcaaggagtggaacacagcaagtcttgagtgagtggagtttgatcccgctgtcactgaagtggctagccctttccagtgcttgttgactccagttcccgcacctgtttgcttgtgctccctcccttgaggagttgagagtggcgggctaagtaaacaaggcacccctgttgagagtctcatgaaggggtcagggaaatatcctgcttcaataccatcatcattcttcacagaagtt

SEQ ID NO: 83682 - DNA, 149 bp, Homo sapiens
atccacagaaccccaatcttggatggctactcgtgtccctccaatctccaggctctcctccctctggttcacactgcacattgcttcactaacctgctggctgcctcaccagcaaccgcgttaccttcggactgaacagagatttcaag

SEQ ID NO: 83683 - DNA, 624 bp, Homo sapiens
aagaacaaaacttcagggttgaatctggagaagaaaagggagatttgaaaccccagaaagtgtggagcaggattgcccgtcgcagagactctcaggctctcaaacagggagacagggcgaggtaaagatgagtggagttttcgcatctattcgggagagactagggcaggcccagcaaattgagggccccaccctaagccgcctagcgctactgagtttaggggagatcggtgacgccccaaaacttgcaggcctgcccagcctcctggaactgcgccctggaacacgcctcgacttctcgtgggtaaggcccggtgcctggaagacctcccagcgcctgcagcccgtctcggccccatgagtggactcagccctggctttccatggggacgcgccccgggactgaatcagccgcccgcgcatgctatgaggaaagttgtatagggaaggccggctgggcctgagcgcctgtggctgggcgggcctaagtttaagactccccccgccccccaccaacctccccagcccggctcccgtggtcgctgaggcatccgccctttgcacctgcaggggctgggcggccggcaggggcgtgtgtccgtgtcaagtgggagcgcccgacag

SEQ ID NO: 83684 - DNA, 544 bp, Homo sapiens
cctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaacaaaaacaaaacaaaacaaacgcaaaaaaatttagccgggcgtggtcgcgggctcccgtagtcccagctactcaggaggctgaggcaggagaacggtgtgaacccaggagacggagcctgcagtgagccgagaccgtgccacatgcactc

SEQ ID NO: 83685 - DNA, 339 bp, Homo sapiens
gcccaggttggaagtggagaaggtcaaaactgctgtgctatccagtagtgggatgacatctgtgaatagccactgcactccagcctaggcaatatagggaaaccatgtctctttaacaataacaacaacaacaacaacaatcccagaaactacaaaaggagagtctttttggtgcctccagtgttagtccctgtccttccagccttatttttcttaagtatatgcacaatgtgaaaggtagataaattcatatccttagacaggtaaagcattcattaattcagggtggtatgcaaggatactatccaaggcatggtatccatgcaaggtgactgcaag

SEQ ID NO: 83686 - DNA, 441 bp, Homo sapiens
gcctttgccctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaaatgtgttttcattagctgggtgtgttggcatgcacctgt

SEQ ID NO: 83687 - DNA, 201 bp, Homo sapiens
tgaagggtgttttatttttaggtcaagattgctatctagcaaagacccaagaactctcctaagatgaaaatttcagaagacaattgtctgtctgagacagatgagatcagtgtttctctgaagaaaagtttgttttcaggaatagagtctgaaattagtcctccaacctgagcgacattggaatagcagtaattcattgat

SEQ ID NO: 83688 - DNA, 387 bp, Homo sapiens
ggattatagcagacataatcatgtgagaggccagagaaagaaattgacaggcaaaagcaagaaattgagtttgtgtttagggaacaatgagtggctctttttgcccttggcagtgggattcacatctaggagaagacagaggaggtggaggcaggaggatcatttgagcccaggaatgcaagaccagcctgggcaaaatggcaagaccctgtctttacagaaaattttttaaaaattagccagccatggtggcctgcacctgtgatcccagatactcaggaggctgaggcaggaggattgcttgagcccgggagatggagactgcagtgagccatgatcatgcgactgcactccagcctggatgacagagcaagatcctgtctcacc

SEQ ID NO: 83689 - DNA, 328 bp, Homo sapiens
cccactgcactccagcctggatgacagagaaagatcttgtctcaaaacaaacaaacaaacaaacaaacaaacaaaaaactagaatgtgttttgggcaccagcaaagcaaggggcatacaattttttttaaatggggcatttccagaaaaaattacaacaaaaaccaaaaacaaaacagtcatagtgagtaaaatcagaacttgattaaatgtccttgactgtagcttacacactggtatcacttttagttgtggcttcataatcttctcagcattcagggtctgaaggcattaccctgctgggcagacagctcccctacataggacca

SEQ ID NO: 83690 - DNA, 967 bp, Homo sapiens
gtgctaaaggttctgctggagcttccgtctctcttctctgcagagggagaatagggaaaggagtgggtgtcagctgggagaaatttccactcagtttaatgttgctggaaatccagacatctctaaaatatgggctgaggacccccacgtgcccagcactgtgccagccagccccagaatgcagagatgaagaagagctgtctattgaggacagaggagactgcttatggatgtgtccttgacagccaccttggctgggcacgtggaagagatcacaggaggcaatgtcagtgagggttgtgcaccactgcaccctgcaagctgcctgagggtgggcccacctagcacagtgcctggcctgctggaggagctcagtacacatttgttgagtgaattagtggaatgaggtagtttaggaaggctttctggaggaaagaaaatctgaacagggcccagagaggatgggtggaatttgaccaggccaagtagaaaggaatgtatcctgtgcggcagagagccctaaaaggagaggtaaggaaggggacagtccacagtaggctgttctagacaggagcatggggaacagctcctttgttactctcaggataaagccaggccccccggttcactcgcaagatccttctcatctggctctgcccacccttcattactgcctcttcccacagcaccctggtcctctattccagctgactcaagcatttatttgcaatccatgggacaagacccttgctctctctcctccaggcctgtgaacaactctcctcccctctgccaggaaggcctccacctgtacctctccctgtctctccagctcctcctgacaccattgatctctcctgacaccagtggtctctcctgcgaggacctcaccttctgaagtcaggtcctagactgaaccatggtcatggtcctagactggtcatgttccagtgcaccagattcccca

SEQ ID NO: 83691 - DNA, 218 bp, Homo sapiens
cctgagtgtagattaccaaaggttgactttcccaggcctttccctgaacacacccagccttcattcctagaccacccagtcccagtggcaccagtgattgtggcctccaccccgctgtgtgccctcagggatacagttgggatccgagatagccaaggctgtcatagagcaggtccctagagagagactcctaagtgacatgtctgtgaacaaacaca

SEQ ID NO: 83692 - DNA, 657 bp, Homo sapiens
tagcacacaagtactcactggtatttcatttgtcgggagaagggttctgggtcttggaatttcccaaatcagataaaatcaagacgtgctgattgccgcgggagaagccagcattatcttcctctggattccctcctacatatctatggggatttactggaaggacttctctggctttagaatgcaaaagcatttataaagtatgccttgagagcctccaaaagattattataatgtggaaactaaaaatgaaaaatatctcgtatctttgaaaacttcattttacccacagcaacagttttatagttcaaggtttcaaggtcatgggaaagcaagacgaagggtaaaagggaagtagttatttgtttccaagaaaatatttttccccttacttaggaccttgaggaccccagttgcctcacacctttcatttaaaaatcctcagttctggctaggcatggtagctcccacctgtaatcccagcactttggaaggacaaggcaggaggattgagcccaggagtttgagaccatcctggcaacagggcgaaaccctgtctctattaaaaaatacaaaatttagccaggcatggtgatagttccggctactaagaaggctgaggtgggaggactgcttgagcccaggaggttgctcagc

SEQ ID NO: 83693 - DNA, 755 bp, Homo sapiens
gaaaaggcaagtttaaccacgttgctctaaagcactagcccctttcaggtttcggacacgtggcctctctggctgaatggacagaaagtctgaatgtgcgacttcttggcagatactgcatcttcagccaggagaagttggcttagtacaaaagggcttttgaagcggaaactacaagaagatgcatctgtcttaacaaaaaataataaaccaagaaaataaaagatatgggatcctagaaataaaaggtgcaacacaagagagagataaagaaaaacattgacagcctctctatgaagaaagacccaaagtaacaactttgcaacagctctagggaataatttgttcagataagagtaactcaggagactccaagagcgattttcgagaagattaaatctatagaatacctaatatgtttgcacttgtaaagaagagttttatactacttggagagaatttagcagttcatctatcagtatcatttgcatagatataatgttcgctaaatatttctatagcctaaggaagatggtgaatgagaagtgtgcttatgtgtggcaaggaagaaggggatttaccaagtgggaagtccatggtcaaatgcttaagacttagtaaggcatttaccaagtgggaagtcaatgggcaaatgcttaagacgtagtaatcagaatgcaaatacataagtacatgtagaggcaaaacatagcattgtagttatgtgcgcagatgctggagtgagactctctggg

SEQ ID NO: 83694 - DNA, 309 bp, Homo sapiens
ctgtgctgagagagaagggaagactggagtggggctcctaggcaccgtcttcagggagaagcccctttcactcccattctgccaccaacccctccgatacaagcaaagtaaggctagattagcatagctttctgcttgtcacacctgctgaatgagcaggattctgccgtttctatctttaagtagaaacattaccactgatttgtagtcatcgcactctccaggagtccttaataaactttaagatcattactgagtcacttagctcttcttttcctcttcacagagttaccagttttctgatctctc

SEQ ID NO: 83695 - DNA, 490 bp, Homo sapiens
atagtgatgtctgattggaatctcaaacgttaacacatcccaaactggagcccacaacttcctgccaggcctctccctcctccagtgttcctcacctctgtgctcaaggccagaacgtctccatctccctgcacccccacatccagccgagctgccagccagccagtgttacgtctgaattacgtctcagacttgaccacgtccatctctgctggccatttctcccttagggttctgaagtggcctcctaccttgcctgcccacttcttttcaccacacttcagcctgttctctgctgcatgcctccagaatggtgtttaaaaaccaaccatccttttggggtgacagaaatgtttgggaagtaggtagaggtaatggctgcacatcgctgtgaatgcactaaacaaccctgaattgtgcatgttaaagctattaactgtatgttatgggaatttcatcttaagttttaataaaagatttttcaaagcct

SEQ ID NO: 83696 - DNA, 320 bp, Homo sapiens
ggtctttatatgtttccgagacaggactgaaactccctgccttcaagtcattttcctaagtagctgggactataggctgtttctttttttaaaggaaggattttatgtttatcatgaaggaaaaaaataaatttggctaacttaaagagttatttatcaggagacactattaaaaaaaggcaaatcagaaatttggagaagatatttttaatactgataataagacagaattgtaccctgtaaccataaatatgtagaatttctaccatatcaataaggtataagtttctgttgctccacatcctcttgcacggttggta

SEQ ID NO: 83697 - DNA, 916 bp, Homo sapiens
gtgccctctctttttaagcactgggctagatgttggagaaggatagggcaatcattcccaaggaaagatagaaagtgatgtcccaagagatgttaatgtcaggttgctaagaagcaggtgaaattatctggatataagctccatgaaggcaaacattttgttggaagctccattcccaaagcttaacacttaattggcagccatttgtatgaataagtgaggttaaacaggacagttccatgcagggaacgatggctgctaacacctatccaggacctagtttccatgaccatgcatatctttttaaaaatttcctttgcccacttcttaaatgttaacatacattttctccaagttaagtttcagcccttttctcattgtccatgtgatctttatgtagtcttatccactgccacggcctcaggttccatctctagttctcaaatttatattcttagcctagatcaggagttagcaaactttttcttaaaagagccagctagtagaaaaaaagataaaagaaaacaacaagaaagaaagagccagctagtaaatatttttagcttgtgagctatatggtctgtcacatgtcccaactctgtttagcttgaaagcaggcatagacaatacataaggatgtgtcccagccaagtgtggtggctcatccctataatcccagcacctcgggaggctgaggtgggaggatcacttgaacccaggagtttgaggtcagcctggacaacataatgggatcccatctccacaaaaataaaaaataaaaaattagcttggcacagtggtgcatgcctgtagtcccagctactcaggaggctgaggtaggaggattgcttgagcctggcaggtcaaggctgcagtgagccatcatcacgcctgggtgacagaggtccaaaaaaaa

SEQ ID NO: 83698 - DNA, 234 bp, Homo sapiens
atggatggatggacggatggatgcatggatgcatggatggatggatggatggatgggcggatggatgcacacactcatcaccagatggatatcaacttagctgcttcattttccgggtttttctggtcttacatttctaaccaatccccagggccaagcatgtcttcatcctgctaatattcccaggccctcccacatgcccagctccatgagggacacagaaaggcactgtcg

SEQ ID NO: 83699 - DNA, 295 bp, Homo sapiens
aatgaatgacttattttacaatgacccatgaccctatttcgtgatatcaagcattttaaactttttatctttgacgaactttccaaagtcaaattctaacttcattcctcattaattttttgatatgagtcctctgaagtccaaaagagacatattggtcttatttggtataaaaatcatacaagaagcatcatcaaatataaaatggtgtttgactttctttgggctgtatttatagaaatgtcattgatatgtgctccaaaattatgggaaactcttatacttctgaaataac

SEQ ID NO: 83700 - DNA, 466 bp, Homo sapiens
atataagaagacactgagatattgcccaatggaaactgcatcttcaaaacagcatatatattacaattccattttcaaaactgatggacataattgaaaaattattcctgatttgatccagaagctcaaataccatcatataaaattatttaaaagtccagaaaaacagatgcaattaacattaagagtggtgttctctggactgtgattttggttttctttataattttctgtattttctaaaatgtctaaaacaacgaagtattaaaagtgagaagaaaatgagttaactgaatcttctattgaaagattttattttggtgcctcttgacaatcagagagcttcagcatgtaaattttctagtgatgtggtatggaataaacttccatttaccatgataatttcaacttttcttacctcacttttcatacaggactttgcattaatctcaccacagtaaatttg

SEQ ID NO: 83701 - DNA, 727 bp, Homo sapiens
ctgctattccatttgcctgcatgtcattttctctctgtatatttgcttgtgaaagtacttcttatccaacaatgcctaactcataaacctcttctactctgtcatcattctaactgctctacatcaagaatggtttccttatctatatttccacagcattttcatgcctcattatttatagtacttatcacacagtattatagttctatatttgttttaccttacctactagtgtaggagttgagggccagattgtatcttactcatctttgtattcttggggcctaacctggtgtagtaaaatagtaattcttcaataaatgttcaatagctgtgaaggaaagcaagtattctataccagtccttgtatttcttctaacaatgctaggaaatgtatggtagaaagaacaaaccagtattgttaaaaagacagcttttgagtatgtacaagtctgtgcaaggatatactatatttttctctataattcagtatatatttccaatatcccttcttggggtatgagagtcatgtttctcaaggaacataatgtctagtagtagaatggacaagacaagtcaggccgtagaagtgccaatgtccagctgaatagcgtaagatttaatttacagttaaagacagtggtagaagagtttgtcataaggcagttcaaaaagatgtctttcaaataactgaaactgtgttttagggattcttagaagagagatg

SEQ ID NO: 83702 - DNA, 281 bp, Homo sapiens
cagcctcccaaagtgctgggattaaaggtgtgagccaccacgtccggcctgacttgaccattttctaccgcccacctccaggaacctcatttcctgtctcttaatataactgatgccctcttctccccagaagtatctcagtcataggtggagactggaatcccatccctgagcccttgctagaacccactgctaaggttacagtgaacacctgccatatccggtccccagcccctaggctatcctgacagttacccagccaaagatctgcaagttcattc

SEQ ID NO: 83703 - DNA, 1702 bp, Homo sapiens
cttgggcagagataaaaggagcacagttccaggcggggctgagctagggcgtacctgtgatttcaggggcacctctggcggctgccgtgatttgagaatctcgggtctcttggctgactgatcctgggagactgtggatgaataatgctgggcacggccccacccggaggctgcgaggcttgggggtcctggccggggtggctctgctcgctgccctctggctcctgtggctgctggggtcagcccctcggggtaccccggcaccccagcccacgatcaccatccttgtctggcactggcccttcactgaccagcccccagagctgcccagcgacacctgcacccgctacggcatcgcccgctgccacctgagtgccaaccgaagcctgctggccagcgccgacgccgtggtcttccaccaccgcgagctgcagacccggcggtcccacctgcccctggcccagcggccgcgagggcagccctgggtgtgggcctccatggagtctcctagccacacccacggcctcagccacctccgaggcatcttcaactgggtgctgagctaccggcgcgactcggacatctttgtgccctatggccgcctggagccccactgggggccctcgccaccgctgccagccaagagcagggtggccgcctgggtggtcagcaacttccaggagcggcagctgcgtgccaggctgtaccggcagctggcgcctcatctgcgggtggatgtctttggccgtgccaatggacggccactgtgcgccagctgcctggtgcccaccgtggcccagtaccgcttctacctgtcctttgagaactctcagcaccgcgactacattacggagaaattctggcgcaacgcactggtggctggcactgtgccagtggtgctggggcccccacgggccacctatgaggccttcgtgccggctgacgccttcgtgcatgtggatgactttggctcagcccgagagctggcggctttcctcactggcatgaatgagagccgataccaacgcttctttgcctggcgtgacaggctccgcgtgcgactgttcaccgactggcgggaacgtttctgtgccatctgtgaccgctacccacacctaccccgcagccaagtctatgaggaccttgagggttggtttcaggcctgagatccgctggccgggggaggtgggtgtgggtggaagggctgggtgtcgaaatcaaaccaccaggcatccggcccttaccggcaagcagcgggctaacgggaggctgggcacagaggtcaggaagcaggggtggggggtgcaggtgggcactggagcatgcagaggaggtgagagtgggagggaggtaacgggtgcctgctgcggcagacgggaggggaaaggctgccgaggaccctccccaccctgaacaaatcttgggtgggtgaaggcctggctggaagagggtgaaaggcagggcccttggggctggggggcaccccagcctgaagtttgtgggggccaaacctgggaccccgagcttcctcggtagcagaggccctgtggtccccgagacacaggcacgggtccctgccacgtccatagttctgaggtccctgtgtgtaggctggggcggggcccaggagaccacggggagcaaaccagcttgttctgggctcagggagggagggcggtggacaataaacgtctgagcagtg

SEQ ID NO: 83704 - DNA, 557 bp, Homo sapiens
cttgggcagagataaaaggagcacagttccaggcggggctgagctagggcgtacctgtgatttcaggggcacctctggcggctgccgtgatttgagaatctcgggtctcttggctgactgatcctgggagactgtggatgaataatgctgggcacggccccacccggaggctgcgaggcttgggggtcctggccggggtggctctgctcgctgccctctggctcctgtggctgctggggtcagcccctcggggtaccccggcaccccagcccacgatcaccatccttgtgggcactggagcatgcagaggaggtgagagtgggagggaggtaacgggtgcctgctgcggcagacgggaggggaaaggctgccgaggaccctccccaccctgaacaaatcttgggtgggtgaaggcctggctggaagagggtgaaaggcagggcccttggggctggggggcaccccagcctgaagtttgtgggggccaaacctgggacccctacgcatcgcccgctgccacctgagtgccaaccgaagcctgctggccagcgccgacg

SEQ ID NO: 83705 - DNA, 146 bp, Homo sapiens
tgatggagacaggaaggagagaacaagtcattgaagacgtggggacagagaacgggcattcttccccttacccccgcctgctcgcatttctccactcccttaatgaatcaatacttatgaagcaattgcatttgccaagaatactg

SEQ ID NO: 83706 - DNA, 1386 bp, Homo sapiens
gacctgttaagagtattctgtaagtcaacccaatgatacacatcatgttcctgtccacatactggttttccccaaatcagctgataaattcagtgtaattccaatgagattgaaactttggaattgacagttctaaagtgcatttgggagagtgaatgtgtgagaacactaagaccactctgaacgatgataatgagttggggggtggactgctcgggggtgatcctgccagattcccagaggattctcacgccaccattacctcactcagtgtgacctggagggggtcagacagacgggagagtccagaaacagacccagggctacaggaatttagtatatggtaagagggatgttttaagtggggaaaaaggtggattatttaataaacagcacttttagacaactagctatcaaagctagatctcagctgggtgcgatggctcacgcctgtaatcccggcactttgggaggccaaggtgggtggatcacttgaggtcaggagttcgagaccagcctggccaagatggcgaaacgctgtgtctactaaaaatacaaaactagccaggaatggtggcgcgcgcctgtaatcccagttacttaggaggctgaggcaggagaatcacatcaacctgggaggcggaggttgcagtgagcttagatcatgccaccatgccactgcactccagcctgggtgacacagccaaaaaaaaaaccactaagttagatctctacctcacagtgtccatacaaattagttccagagggaagatataccacaaaattactcaaaaatttttatacctctggtgtgggacggtcttttctaaactttaacatgagacttaaaagatataataagggaaaagataagcagatttcgcaaccaaaaaatatcgaaagtctctgtgtgatggaaaacatcaaggttaaaacacaaatgacagatatggaagaaaatatttgcagcacataaaaaaatcaacgagtacaattactttaggagaaaagcttgcttcagggtccttagagaaagtcactggggcctgccaagctgccacctaaagacaagagtgagagggctgagttcttccaggtcatcagagttgttgctgcccgtattaggccacacagtggaaccccatttatatcatagcagaagaaataggattatcaatgtgaactgcttagcatggtgcctggtatatacgagagctccacaaatgtgagctataatcctactagtaaaggatgctaagcagttccactgtggcaggtgtcatttgctagtagaatttgtaatcaaacaataggaggggaatctgtgaacgcctagaaaatgagcagaataaaggatattatctttggaagtcttaaaaaaaaaaa

SEQ ID NO: 83707 - DNA, 633 bp, Homo sapiens
ggcatgcggaccccgcacccagagggacatggtggggtgcggggtgcgggctgggacgccgcacacggcacgctgcacttacactggagccgcatgcagggaacgggggacacggcgggatgcgggctgcaggtctggggcacacggcgcaggttttcacggggctgcgcgcgcgcgtgtgtatgtagtgggtggaggtcccggtgccaccgtgacacaagggcctgagtgacttaggcctgaggggtggggggaggagggaccacacctactgtgacctccccaccgcgatccctgcctggcctaggcctcagccaccaggtccaccagcctcttcggtctttgcaagcctgcccactgtcccaaccatctttgagaacccagactagacggtcaggaccccgacccaaaacccttccacaggtcccatggctaaatcccaggttccccaccctcccggcaggcccgcaggaatgccggccccgcctctccatgccggccgcccccctgtgctcctttagctgtcatcgcaagtggtcccgtcccccagagcttcgtccctgggtcgggtcatgctgttggggacgccctgagcgctctcagcgcaccgttggccctgctcgctccccaccg

SEQ ID NO: 83708 - DNA, 760 bp, Homo sapiens
caggagcctgcagaaaaacctagtgcggggccccacgggagcaggggtggccggtagtcattgctgcttcttgttaggctgctcaggagagccctggtctccacctccgtgaaatagggtgggaccagccacctctgtgggtgagagagccaggccctgggcaggcacagagctatgcaggtggccccctctcagtgcctgccctaggctctgcttgtgactctcttctcctcacctgtgccccacgcttgcagccccagctgtgtgggttccacttctggtgctctggagtctggggggaagaggcactgtggtggcccttgagactccttcctgcctccctccggagcagagagtaaagaggagccggcagtgtctggcctgcatctttccatgtggacaggagccctcccgggaggcctggaggcagagggaagaggcggagggtgccatggtccacagggagctgtgggaaggtgggagccctcctgctgcaccccaggcaccgtcagggagaaccctggtgacctgggcgagagctgggcccgagttgggatctttgatggggaggggagtgagagcagggatgtgctctggtggtggggagcctcaggtcaggtcccagaggacccaggagagctcatgaacacagggctggcaggttgtcagggaagagccgaaggagctgtggtagcctccaggcagggagctcttcctgggctggagggaggtgtgggattgttggagtgctgctctcaca

SEQ ID NO: 83709 - DNA, 458 bp, Homo sapiens
ctaccacatccttccaaatctgtttgttctctggcctccctatgtcattaagtaatgccaccatattgaaattgttcaactgaaaacttggaaaacaatctcaatccatgactccttcagcaccttcctaaagctaaatgtagtataattgtctccaactggccttcttttcactcttctcccaactccaagcctatattttctccctacagcagccagagtcgttttttcatattatcattaggtagcattatttcccttttgaaatatcatcaaaatattttcataatacattttataacataccaatgacacctaccatatcgtacacattcttacttggcatgacccctgctcatttttccaactcttttatcattcttttccttgtttattcttcaaagcacaatgacattcctattaattctggaaaaataaaagtgaattcttatctcgga

SEQ ID NO: 83710 - DNA, 497 bp, Homo sapiens
gtccacatcccaactaccagccgccatctccccatccgtaagaggaggggttggcccaagcggctctccttgctctaattctgcacttccaggtccagacggctccctggacctccccacatgctggtccaggccctctggaggcagtgaggcagccaagccaagcccagccccactgcacttccaagcccccaagagacccccagccagtgcctccatggaggagcaggcctgggtgccggtggctcagccgagaagaggacagtttccacaaatggcacagaaggctctgggtgggaataatagagggttgttggctgaaagaaggacagggggtaatcgaggcaaagcccacgccacaagcacactgggaacgatgccgccgcgccccggcctcccacgggccggatgtgagctggcagtcctggccgtgtcccgctgggaggggccgcactgggtccctgtcgtgctcagtcctgcctccacctcccacctcg

SEQ ID NO: 83711 - DNA, 190 bp, Homo sapiens
gccataatattatttattggctaattttctttttcccctcctacttaatacatgctcactgtagttgtcatgtcatacattttggtgagtcacatagtatcccctctccagaatggctcctactgatacagtcaatattaacaatttggtgagtttcttgaatacattaccgtgcttatacaaatgtaga

SEQ ID NO: 83712 - DNA, 529 bp, Homo sapiens
tttacttcgttgcaagaaacaatcagttgtaagcactagggattaaaagccaaattgaactcaggcattttgagagcgcctggggagaaggcattggtgcatttggctgagttccacccatttcagcataagatggacgtggagcatttttcacatagttctgtaggcagcctgacgccagagttttcacttcagagaaaggataaaagttgacggtttcttagggaacaaccaactcttcctcatttgcaatgtctgttctcctcaaagatgtcgtgggcaacgcttgagatgggcactcaatgactcaaagggtgggggttaggcagaaacaagaccctgggcatttagaagcccttggacgattacatatatttcaaaatgagttaagttcaaataattttttgctggtgcttagcacaccaatgaagtatgtagatatgaaaacaggaggctgctaggtaagattcattttattggcactggttccagatgccagcatcgtgatgaacgctatttgacttctgat

SEQ ID NO: 83713 - DNA, 306 bp, Homo sapiens
gttgcagtgagctgagattgggccattgtgctccagcctgggcagcaagagcgaaacttcattccaaaaaaaaaaaaagaaataataaggtatcaaaggaggaatcacaatagaaattggtacctttaaatagataaaaatgaaaacacaacaccaaaacttatgacatacagctaaaacagcactcagagggaaatttatagctgtaaatgcctatactttaaaaagaagaaagatgttatattaataacttaaccttccaatttaaaaactgaaaaaaagagcaaactaaacccaaagcaagca

SEQ ID NO: 83714 - DNA, 205 bp, Homo sapiens
aaattgagtatattaaaatgtaattccctatcctttaacatcatatagttcagactgagtttttcagttggattttctttcttctgttgattctgtaacaactttctttcaagctaaagtagagaaaagcttttgcatttgatatacttttctgctttcaggataaattacaggaagtagaaagttttttatccagcaaaatttg

SEQ ID NO: 83715 - DNA, 314 bp, Homo sapiens
agaggagacaataataatacaattaatgaaagaatatgcaactgtatgtcctggttttattggatgattatcatgttttttattttcaatccttaattcattttgattttattaagtatattctgctatatataatttgtagtatctttgtagtagttctgttgaatattatgttaagggcaggaaaagacaatgttatgtttggtgcagaataaaggtgaataggcaaaacttcactcctgctgaaaaccaaagcacatttcaaagccaattcagattcagcagaagaggagatagtctccactcattgatgg

SEQ ID NO: 83716 - DNA, 476 bp, Homo sapiens
ttgactttgaactcccatcccataagaacagtgggacatcaaacttctgtcatttttggggttccccacttcacagtgttgtgtaaagacccccaagtcttaggaagcatctagagcctggggaggttccacaggtctcaatgattagcctacacctctgatttcacatagtactctttgctgtgtgcttagggctgggcactctctggtgagtttggaatctttcctttttggagtcttgccccattcctagaggaactactgcagagcagagtgaggggcacagcgccctgcttcccacagaacccaaagcgttctccatccgtgttttctccaagggtcctaccttctactttcctaaaaattatggacataattgtcccagtggtctcaggttttgaaaaccaaaactatgaaggtaagtgttctttaggcttctgcattctgccttgccatgaacttttcctaaggcaaaa

SEQ ID NO: 83717 - DNA, 582 bp, Homo sapiens
actcctaaggtctcatgggtcctgaatcctttgcagatcacacacaagtccccagctaaaagctctccatagaggaggtggtaattactaactgtttttaatcatcactcccacctgccactgaggagaatcaaagctgctctttccaatgcccaccaccacaccaaaaggcaggcagcacaggcctgcatgaggccactagaagcctaaaatgtagagtcttggctgctctggagggcactggagtttggaggttttttcccttgttggagttactggcaatttggggactattggggttttacagcatactggctcttcaatcaacctctctgagatcacttatctgacaagcactcctgcatccactctggggtcaggccccgtgcaaggtgcagggctctcactgtggctctccaggagccatgacatggtgtgactgcttccgccagaggtgtggacatgtgtacacagaggagggaggggtgggaggtcaggaagcctcccaaatggcaggacagctgagctgaacttaagaggatgaggaggataaaggtgtgacacacaagtgaagacacagag

SEQ ID NO: 83718 - DNA, 453 bp, Homo sapiens
gtgcaaaagaattaattgccacttattttaatttgttatatttccatcctaaaggatgaatctcccaagagggccaagagagaaggtggtttggcccctagtattctgttaatagatgagagaagcaatttgttcacttgctttcacaggctgtgctctgtggtttatggctcagttttatctggccaagttaaaacgtaaacttcatccttaacagttttctatatacactggcctttctgtttcactagtacataaaaaccatttcaacatttccaatggacacaaatattgtgtctgttgaactatctaaaatgattccattccttatttacaagagagagcattctaagactctcaaaatgtaaaatactatacattttgaagacagtttctttgtatgcaatatgagtaggattatgatgaaaacacacagagtctgcagtgccccat

SEQ ID NO: 83719 - DNA, 438 bp, Homo sapiens
gcgcatgcatcaacaggagaagtgattttcttgataagtaatcagtgtctacaccagatcctgcgccaggatcctaggtatcaccttagctgacaaggcagcagcatttgtactagctcagatgctgaagatatacaaaaggcagatgatgaccttgcttcatacttctttgagaacacagagttaattagataggaaatccctcatcttctccctgccaaatctgccaacacacctgcttctgtgctcacatcttcactgccctgccttctggttccgtgggtgaactttctgcttttacccaagtcagccttttctccttgcactttgggtcccttccttctcactatgtcctggatttcctccttgcatttatccattttatttgctgcctcactatttctgtctctccactgtattttatccttatcactagtg

SEQ ID NO: 83720 - DNA, 654 bp, Homo sapiens
gccacatgctcagccgagtaattttactgatgttctatgtgatatatttaggaattctagcttaaagaagtatagacctttagagctgaaagtgaatatattgatttagtccaacccttttgttttagagaaaatcaaggcctgagagaggaactaacttgtgcaatataatgtattaatatagcaaatatttactgagttcctgccgtgccacatatactgtattaggtgatgtaccggtatacagtgagagcaaaacagaaacaactcctgctctgaggaatcagatagtatattagtagtgtggaatctggggtgatttgggccctagtgcctttgccttcattgccagggctggcccagcatatctagctgcctatgtgggtgagccttgcttcattcaacatgtctcacaaacctcaggatccatttaggaaatggctatcctaataaggctgatgaatagccacatccccttccaaagcctcgttattgtgagacctactctggacttgttcatggagtaagatgcctttttttttttttgagatggagtttcgctcttgttgcccagggtggagtgcaatggcacaatctcagctcactgcaacctctgcctcttgggttcaagcgattctagtgcctcagtctcct

SEQ ID NO: 83721 - DNA, 368 bp, Homo sapiens
agaaggaaggcccagccacacaattagacctgtaaggaaggcccggaccatcatgtaaggactatgcttaaaaaacaatgaagagcaaggcagaagccaggcatctaattttcttagaagatcaggaaaggactacccattatagctggggcacaatatgagatgtgctggattcactgaacaaaataaaaagttcagggaccacactgaaagttgactgtgaaggcaattctccttcccttagctctacaccagactgagagctgaggtgggaggatcatttgagcctgggaggcagaagttgcagtgagccatgatcaacgccactgcactccagcctgggcaacagagtgagaccctgtctcaaa

SEQ ID NO: 83722 - DNA, 667 bp, Homo sapiens
gcctgtagtcccagctactcgggaggctgaggcaggagaatggcgtgaacccgggaggcagagcttgcagtgagtggaggctgcagtgagctgtgatcataccactgtactccagcctgggtgacaagagtgagaccctgtctcccaaaaaacaaacaaaagctatctaacttaaatccaaacaattacattttgttcttgcccatttggttcttgcagctaaaatacctgaatgttacctgtaggcaacctttgctttttactgggtgcactacaaaaacaataaattcacagcctgtcctacaatttggtcattgaatgctgatttccaccttcatgaaagatagtttggagagaaaagcaccacccattttattccagtagattgagtctgcatgtgcctgggtacaccctaggatctgaaaagtctggcctggcgttttagtcatagagattattagtcacctagaaatcttgctcccacccttccttaaaagagattctgagaaacagttttgttggggcacagctctgatactataaattctaaagtgatctgatgaagcttaaaatcatttttctatttcacccaattatgaccaaaaaaaaattcatatatcttaaaataccaagaataagtaggctactaccctgatgcctgtagttc

SEQ ID NO: 83723 - DNA, 1689 bp, Homo sapiens
  misc_feature (1103)..(1103): n is a, c, g, or t
  misc_feature (1105)..(1105): n is a, c, g, or t
  misc_feature (1130)..(1130): n is a, c, g, or t
  misc_feature (1275)..(1275): n is a, c, g, or t
  misc_feature (1543)..(1544): n is a, c, g, or t
  misc_feature (1605)..(1605): n is a, c, g, or t
  misc_feature (1608)..(1608): n is a, c, g, or t
  misc_feature (1611)..(1611): n is a, c, g, or t
aactacaagactggtcaggaaagaccacacaaaaattgagtaaacacacaaaaggtttgaagaagtaatcaaaagagaatacagaggaagtgcattccatccagtgggaaggggaagaacaaaggatccttggaggcaggaatgcaatgtaatgactaattactatttgtgaggctctggtccacatggatgaggaaaaatcatgcctgttttgttgaaactccaaatctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtgccctttatgagtatgtcttctgtccagatgttgaattcaaacgtcgttttaaagaagccttcagcaaagctgcccagcaaacaaaaggaagctacatggaggtggaggacaacaggagtcaggnanagacggatgacctgattctaaaacntggagtggtgcatgtgattgacgttgaccggggagaggagaagaaggggaaagaccaatctggagaggtattgtcttcagtatgactagaagatcgcactgaaagcagacaagactccttagaactgtcctcagatttccttccncccattaaggaaacagatttgttataaattagaatgtgcaggtttgttgtttcatgtcatattactcagtctaaacaataaatatttcataatttacaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacanntctatcagcttattccttctctactggaatattggtatagtcaattctattgaatattatnctnttnaatgcccaaggtaatgtggactaaagcccagaaatttgaaaagaatattcagaaatccttcccaaatcataagggccc

SEQ ID NO: 83724 - DNA, 1542 bp, Homo sapiens
  misc_feature (956)..(956): n is a, c, g, or t
  misc_feature (958)..(958): n is a, c, g, or t
  misc_feature (983)..(983): n is a, c, g, or t
  misc_feature (1128)..(1128): n is a, c, g, or t
  misc_feature (1396)..(1397): n is a, c, g, or t
  misc_feature (1458)..(1458): n is a, c, g, or t
  misc_feature (1461)..(1461): n is a, c, g, or t
  misc_feature (1464)..(1464): n is a, c, g, or t
ccaaaaacccaatcagacaagtggccgtaatctgactcccagcacacagggagctgcagggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtgccctttatgagtatgtcttctgtccagatgttgaattcaaacgtcgttttaaagaagccttcagcaaagctgcccagcaaacaaaaggaagctacatggaggtggaggacaacaggagtcaggnanagacggatgacctgattctaaaacntggagtggtgcatgtgattgacgttgaccggggagaggagaagaaggggaaagaccaatctggagaggtattgtcttcagtatgactagaagatcgcactgaaagcagacaagactccttagaactgtcctcagatttccttccncccattaaggaaacagatttgttataaattagaatgtgcaggtttgttgtttcatgtcatattactcagtctaaacaataaatatttcataatttacaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacanntctatcagcttattccttctctactggaatattggtatagtcaattctattgaatattatnctnttnaatgcccaaggtaatgtggactaaagcccagaaatttgaaaagaatattcagaaatccttcccaaatcataagggccc

SEQ ID NO: 83725 - DNA, 624 bp, Homo sapiens
tttcaccatattgggcaggctgatctcgaactcctgacctcgtgaccagccgacctgggcctcccaaagtggtgggaaagtggtgcgattacagatgtgagccaccccgcccagcctcacctagctaatttttgtaaagacagggttttgccatgttgcccaggctgatcttgaactcctgagctcaagcaatccactcgccttggcctcccaaagtgatgggattacagatgcagccaccacgcctggcccaaaaattctttttttaaaatcaactatttaaaccctccggcaatggtcctgagggcaaacaacaaatgaaaaaacacctattcaagaaaatctacaaattcggtaagaaagatgagagggtatggtatttgaaccaagatcattccctccttactcactcctagcttagtgaggtggagcttctactccagactattgcaaactgtaataccgggcactgctcccccagctcccaatcaaatgctttcttcccaggaaaagcaggacatcagcatttctcatcctacctagagctacttgttgctgaggttaaaacctgtgtgagtgcaattgaaagttggagctctctttttttttcttttgagacggagt

SEQ ID NO: 83726 - DNA, 285 bp, Homo sapiens
agagggacggatgggggaatgtgaatgaaaatcctggtatttcctttacccaacaacggtctatagtctatagatgatcctgagggtgaaggcttgaggtctgccaccatacataccttttgaaactcattgcattatttgcattagttctcagaagagaactctttttttaaagtccatactaaaggcaatgaactgcttcatgtaaagtaacactaggtaagtttggtaataagttgtgcctttagggtcttgaaatataaaattgtgagcaaagattatctg

SEQ ID NO: 83727 - DNA, 609 bp, Homo sapiens
cttacttcttcctaatgtagaaatactttctataacatccttgatgattagacactgaattccagagctaacactctagcaatgtagaactggctgaggagtaccttgttacaagtaaaagagcagtggatgaaatgttgggatagctggggttatactcccaccccactcctgaaggtaagcgacttattccattgtgcaccttggttttctttcctctaaaacatagttgttatttattgattgctaagatgccttagaggcctgccaatttgcaaaacatttcataagaaaatctttgccaggaagtcctaattgttagaaatctgcctcctttaaccacacaattgaaagctaggtatcacatctgccagaagcattctttcttccggaccttgcagagtccttagaatatatttcttgtttgtatattattaatatctcctttagtgtttaatcaaatgatatagtggttaataggacaaaatttattcatggtattttggtggaagaagataagtggaaggctgaagctctgcaactcatagtgtaagcattttaaagactattttagtaaaagattaaataaagaatattattttagcaatc

SEQ ID NO: 83728 - DNA, 371 bp, Homo sapiens
cttacttcttcctaatgtagaaatactttctataacatccttgatgattagacactgaattccagagctaacactctagcaatgtagaactggctgaggagtaccttgttacaagtaaaagagcagtggatgaaatgttgggatagctggggttatactcccaccccactcctgaaggtaagcgacttattccattgtgcaccttggttttctttcctctaaaacatagttgttatttattgattgctaagatgccttagaggcctgccaatttgcaaaacatttcataagaaaatctttgccaggaagtcctaattgttagaaatctgcctcctttaacttctgcccaggccctctaatcttgactctag

SEQ ID NO: 83729 - DNA, 320 bp, Homo sapiens
ctaacaatagtggtgttatctgcaggagtggttggagaagctgcaaatattgtgacctctggaataatggctggtaatccattacatctgtacgttagtataattcgggttcctaccatcctcctaacttggtggcctttcattagttttgcaaaggtggtttagtttctggggagggctattatcatttaaactataaattaagctttttgggaggaggggaatccatacaaaaaagaatcattttgtagtcttaaaatatttgttaatttaataaagtttttaaactatctttagtgattggacttcctaccaaaatg

SEQ ID NO: 83730 - DNA, 283 bp, Homo sapiens
tactgggattacaggcatgagccaccgtgctcagctaatacattttacttaacctaatatatcaaaaacattttcattttaacatgtaatcactatttgtaagttgttaatgaaatattttgcattttttgtttgtttttgtttctttttttggtccttctcagtctaatccatattttgcatttgatattaagccttcaaaatatagtgtttattttgtactcacagcacatctcaatttggatgctaaattttcatcagaaatacttcatctgtatttaaa

SEQ ID NO: 83731 - DNA, 706 bp, Homo sapiens
gtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttattt

SEQ ID NO: 83732 - DNA, 849 bp, Homo sapiens
gtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttatttttcttttctttctttctttctttttttttttttttttttttttttttttttttttttcccccggggggggccccactttttttttttcccgggggggaaaaaaaccaaaaaacaaaaaaattttttttttcctcaaaaaaaat

SEQ ID NO: 83733 - DNA, 464 bp, Homo sapiens
agtggagagagaatggagtgtaggctggagcccttgcttgccacttgggatttcaattttccaatttaaaaagttctctaagacccttctaacactctagtaacgactgaacctagaatggcctccctctcaactccctaagtctcttctgttgcccaagctctagtgccacttcctccaggaagccttcctgacctttagctgcatctactctactcattcggtcttacagactggaagccttaatttaagagcaaacactttttggtgctcagtatgtgccaggcactattctacgtgctttacacatattagttcatatcatatcacactgttttttgaggtaggtagtattatcatctcccttttatagtcaggaacttgaggaaaagagggtttaagttgttcaagttgacatagaaagtgatagtgctgggattcaaacccaggcagtgtgacttcag

SEQ ID NO: 83734 - DNA, 685 bp, Homo sapiens
taaattataaattagtattcttccttaccttttaatgtctgaaagctcttagaatacagctggcacttaactgcagaattctggactctaaataatttccaaaaattagggaagttaataattttgggttacctactaagtagcaagtggacagtaaaacattaggcttgttagggtgacattatctgcattttgtggataataaggacagtgtgtgccacaaagttatatagctgaacatataaaggaagtagaccatgttaaacttctgatggatttcatagtaagaaattggtgtatgattagcagagagcttctgggcccttgtttgttgattaaacattgaagaatttttttcttaatgataaattcgagatactctcaaaatagagatattctatccagggccatcaaacagttttgattccttagtatgactcactacatcttttttcttgcatattccgtaagtttactgtagtattctcaaaacattgaagagtttggaccaaaaattcaagcagtgaaactccatgcagtgtaaaatttgagttctgtagtgcagatttgattttttaaacacagttgttctagttattttaaagtgtatgccttactgaaatagttaccagtgaaataataatgttatctgggatttgtattgaaattctccaggaaaaaaaaa

SEQ ID NO: 83735 - DNA, 114 bp, Homo sapiens
tgcagattgggtgtcctggtgctggtctcgtaacttgacttttaggagctattgccagaacattgttctctggtctacttttcatttttaattttaaaacattccttgttttta

SEQ ID NO: 83736 - DNA, 697 bp, Homo sapiens
ggcctcctccaggatctgccccatcagtctcttcctgactgtatctccaggggtgggttggggtggggtgatttggcctgaaagaaccgtgtggaaagagggaattgtctgtcaaaatgttctagaaagctgggcagcttatgaaaccaatggaggagtcttcactgctgcttcacagtactgggcagtggagtcagccagacctttctttatctcaccaggcatctgagaggtgggtcgtccccgctgtagtgctgtttctgggccccagttgatgtcttaacttgcttttctctatttcaggtctcgaaatctctctaattcacacacatcattcccaaatcccagaaacaaactatggtagattttatttttcaaaaaagagtgggatccattcgcttttgaaggccaaggtgggaggattgcctagaggccaggagttcgagaccagcctgggaaacacagcaagaccctgtctctacaaaaaatgaaagaaaaaaaaaaaaaaaagccaggtgcacatgactgcctgtagtctcagctactggggagactgaggcagcaggatcccttgagcctaggattttgaggctgcagtgagctatgattgtgccactgcactccaggctggccaacaagagtgagaccctttctaatacatatatatatatagattttttttttaagtagggagaat

SEQ ID NO: 83737 - DNA, 167 bp, Homo sapiens
agagtgaaactccatctctaaaaaaaaagaaaaattagggctgtcgcctgaaggaaacaacaattatttatggcagttatacagttcctgcctgttcatttcttggtaattcatagtgcctagcattttgttcatcataaagtacatgctcaacaaaattatcaaat

SEQ ID NO: 83738 - DNA, 480 bp, Homo sapiens
tctgtctgtatcctggctttgagtgtttatctaagctaagcccaattgactgttgtcattctttgtctcttccttgctcagacatcagttaggtatttattgaacactcctgtgttcacagcatccggctcctgggattagagacagctcttgactcctggttttgctctttgaaacctattggactgcttttcttttaagatacaccccccacattataggaatctatccatttctttgttcatttctttaattgtgcattatatcagtccgtcagtcagttttcctcctgaaatatgctaagtattgagaattataatagattctattaagcaccgctaataaagtactatccttatagtagtagtagtgtttgcggtgatggtcgtgttagtactagtagtaatcaagatggccatgaagagactgcttttaatctaccagtaatcatggtaaaaatagtaatagctcaaatgtatt

SEQ ID NO: 83739 - DNA, 178 bp, Homo sapiens
ggtgtcgggggctagagatacacatgccagttctatacatttctcagcactgtgctgtcgattcacagcagttcaattgttcaagcgatataagccagtcatgtggcccaagttattctgtcggctgtgttctctgcaggaatctgatgcaagaaggcctgaaggatgcatggctttg

SEQ ID NO: 83740 - DNA, 478 bp, Homo sapiens
tttttttaaacttttagtagagacagacagggttttgctgtgttggccaggctggcctcaagtgatctgcctgccttggccttgcaaagtgctgggattacaggcgtgagccaccatgcccagccctactctttatgtccaaaagccgaggccttcctgtaggccattcatgatggattgctgctcaccccacgtggccattaacacatggctgttggtttccaacctggccccttgtatgaaaaaccctaggtaaacacatcaaaataattatcccccggcatagcactttatttaaaagtccctcattttatgatgaggaaatggggcctccaggagggcaatgggcagagtgtgaccatcctacccactgcctctcaggagccccttgtatctgccacgagtggcctgcctcactgcaagctgtggcacagatacgtagttagacatggttaataaaaatcattgtgatttaata

SEQ ID NO: 83741 - DNA, 260 bp, Homo sapiens
atgaaatttattaaaactcagcattgtttttgttttagcactttgcagattttcttcaagcattcagtgaaaacaattttgatctcagtgtataaaactatcttattgattttttaatgaactcatttctctgtatgcttctcacctagatgtgtacttcccagatgtttaataaggtatttattcagccttttataactctaggagttgaagtggaattttatcattggtttctttagagctttcttaactgcttatca

SEQ ID NO: 83742 - DNA, 2899 bp, Homo sapiens
taaattttgctttaaatttaattgcttttctcctttttctctaataataggactatttcgcagtttccagtccttgattaattaaggcttcagagttcgttcttacatatgccatgtcttaagttttcataaaattcagtctacacaagacttgctttttgtgagcactgtgcttagtggcagtccggatttttccctccacccccgcggccacccctgcccaccgcgccgtcgggcatggatctggcaggtgcgaggccgaggcccagggctcagcgaaggacgccgagtttacagagcgcgcgcgccctagaggaggcagcagcagccgcaggcctggccgcccgaactttgcgagcctggcgggggagcacagaggcgggccgacctgccccgctagcgctgaggaacgactccctttatgccagctcgctgtccgccttcccgcagcgtacgctgcggagcctcaaagaccctgcggccctccacaaccgtcttaaataacaaacccctgtcctcgcccccgtaggaattggggcagctgggggttcgcgtcacagactcaagcccgccagcagaagggcaggccggacttcgcggggccgaaccccgctccagctggggacaggccgcctagccggcaggagggagccggcgcgagagacttgacgggaggaggtggagagcgggaggcgggaatgagggcgcgggaccgggcgggcggagcgtgcgagactgcgagcgcgagcgccagcagggcggagggcggggcgtgggcggcgcccggccttcccgctcccgcggcgctgcaactctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacggcgaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagcggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacagga

SEQ ID NO: 83743 - DNA, 1880 bp, Homo sapiens
taaattttgctttaaatttaattgcttttctcctttttctctaataataggactatttcgcagtttccagtccttgattaattaaggcttcagagttcgttcttacatatgccatgtcttaagttttcataaaattcagtctacacaagacttgctttttgtgagcactgtgcttagtggcagtccggatttttccctccacccccgcggccacccctgcccaccgcgccgtcgggcatggatctggcaggtgcgaggccgaggcccagggctcagcgaaggacgccgagtttacagagcgcgcgcgccctagaggaggcagcagcagccgcaggcctggccgcccgaactttgcgagcctggcgggggagcacagaggcgggccgacctgccccgctagcgctgaggaacgactccctttatgccagctcgctgtccgccttcccgcagcgtacgctgcggagcctcaaagaccctgcggccctccacaaccgtcttaaataacaaacccctgtcctcgcccccgtaggaattggggcagctgggggttcgcgtcacagactcaagcccgccagcagaagggcaggccggacttcgcggggccgaaccccgctccagctggggacaggccgcctagccggcaggagggagccggcgcgagagacttgacgggaggaggtggagagcgggaggcgggaatgagggcgcgggaccgggcgggcggagcgtgcgagactgcgagcgcgagcgccagcagggcggagggcggggcgtgggcggcgcccggccttcccgctcccgcggcgctgcaactctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacggcgaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacagga

SEQ ID NO: 83744 - DNA, 3357 bp, Homo sapiens
taaattttgctttaaatttaattgcttttctcctttttctctaataataggactatttcgcagtttccagtccttgattaattaaggcttcagagttcgttcttacatatgccatgtcttaagttttcataaaattcagtctacacaagacttgctttttgtgagcactgtgcttagtggcagtccggatttttccctccacccccgcggccacccctgcccaccgcgccgtcgggcatggatctggcaggtgcgaggccgaggcccagggctcagcgaaggacgccgagtttacagagcgcgcgcgccctagaggaggcagcagcagccgcaggcctggccgcccgaactttgcgagcctggcgggggagcacagaggcgggccgacctgccccgctagcgctgaggaacgactccctttatgccagctcgctgtccgccttcccgcagcgtacgctgcggagcctcaaagaccctgcggccctccacaaccgtcttaaataacaaacccctgtcctcgcccccgtaggaattggggcagctgggggttcgcgtcacagactcaagcccgccagcagaagggcaggccggacttcgcggggccgaaccccgctccagctggggacaggccgcctagccggcaggagggagccggcgcgagagacttgacgggaggaggtggagagcgggaggcgggaatgagggcgcgggaccgggcgggcggagcgtgcgagactgcgagcgcgagcgccagcagggcggagggcggggcgtgggcggcgcccggccttcccgctcccgcggcgctgcaactctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacggcgaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagcggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggtgggtgaatgccttttcttccccctgaatgtctttccttccgcggtattttctgccccgatctatagtcccttgagtctccacacacactcctcacagagatctgtagcgtaggtacgtgacagctctgcctacatctgacgtccggagtcattaaccaggaatgtatgtgtgtctgtgtgtctctctgtggagtcgtcagaattcttcataggggttaagctaaaaaagcgaggcgaggagcccctctccaatggctcagttttgctgaataatcacgtgtgaatcgaggggcgggcttttggcaggcagatcttactagtatttactaccaagctctactccagattaaccatcccagtccttctgtcagtctccgatgccatcatgcagcctggttaggagcaaaggaaaggggaaaaagaaaaacgactaattcatcttttcctgatcgtcaggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacagga

SEQ ID NO: 83745 - DNA, 3639 bp, Homo sapiens
taaattttgctttaaatttaattgcttttctcctttttctctaataataggactatttcgcagtttccagtccttgattaattaaggcttcagagttcgttcttacatatgccatgtcttaagttttcataaaattcagtctacacaagacttgctttttgtgagcactgtgcttagtggcagtccggatttttccctccacccccgcggccacccctgcccaccgcgccgtcgggcatggatctggcaggtgcgaggccgaggcccagggctcagcgaaggacgccgagtttacagagcgcgcgcgccctagaggaggcagcagcagccgcaggcctggccgcccgaactttgcgagcctggcgggggagcacagaggcgggccgacctgccccgctagcgctgaggaacgactccctttatgccagctcgctgtccgccttcccgcagcgtacgctgcggagcctcaaagaccctgcggccctccacaaccgtcttaaataacaaacccctgtcctcgcccccgtaggaattggggcagctgggggttcgcgtcacagactcaagcccgccagcagaagggcaggccggacttcgcggggccgaaccccgctccagctggggacaggccgcctagccggcaggagggagccggcgcgagagacttgacgggaggaggtggagagcgggaggcgggaatgagggcgcgggaccgggcgggcggagcgtgcgagactgcgagcgcgagcgccagcagggcggagggcggggcgtgggcggcgcccggccttcccgctcccgcggcgctgcaactctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacggcgaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagcggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggtgggtgaatgccttttcttccccctgaatgtctttccttccgcggtattttctgccccgatctatagtcccttgagtctccacacacactcctcacagagatctgtagcgtaggtacgtgacagctctgcctacatctgacgtccggagtcattaaccaggaatgtatgtgtgtctgtgtgtctctctgtggagtcgtcagaattcttcataggggttaagctaaaaaagcgaggcgaggagcccctctccaatggctcagttttgctgaataatcacgtgtgaatcgaggggcgggcttttggcaggcagatcttactagtatttactaccaagctctactccagattaaccatcccagtccttctgtcagtctccgatgccatcatgcagcctggttaggagcaaaggaaaggggaaaaagaaaaacgactaattcatcttttcctgatcgtcaggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacaggaaaaaaaaacacaaaccaggaacaaaggaaggaggagaggagcaagagatgacccagaacagcgaccaagaaggggggcgggcgccaaaaacacacccggggggggcgcagtagagcgccccaccagtaggtggcaagggggcccagagagcggatatacaagaagagcggcgccctaaacagcccagaggacacgaccggcacgcaggaccacccgcgggggatagggacccaggagtggcgcgaaacgggtggccagctgcggcaggcgcctacatcggga

SEQ ID NO: 83746 - DNA, 3248 bp, Homo sapiens
taaattttgctttaaatttaattgcttttctcctttttctctaataataggactatttcgcagtttccagtccttgattaattaaggcttcagagttcgttcttacatatgccatgtcttaagttttcataaaattcagtctacacaagacttgctttttgtgagcactgtgcttagtggcagtccggatttttccctccacccccgcggccacccctgcccaccgcgccgtcgggcatggatctggcaggtgcgaggccgaggcccagggctcagcgaaggacgccgagtttacagagcgcgcgcgccctagaggaggcagcagcagccgcaggcctggccgcccgaactttgcgagcctggcgggggagcacagaggcgggccgacctgccccgctagcgctgaggaacgactccctttatgccagctcgctgtccgccttcccgcagcgtacgctgcggagcctcaaagaccctgcggccctccacaaccgtcttaaataacaaacccctgtcctcgcccccgtaggaattggggcagctgggggttcgcgtcacagactcaagcccgccagcagaagggcaggccggacttcgcggggccgaaccccgctccagctggggacaggccgcctagccggcaggagggagccggcgcgagagacttgacgggaggaggtggagagcgggaggcgggaatgagggcgcgggaccgggcgggcggagcgtgcgagactgcgagcgcgagcgccagcagggcggagggcggggcgtgggcggcgcccggccttcccgctcccgcggcgctgcaactctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgctgagcgctcgccgagacggcgaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagcggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggtgggtgaatgccttttcttccccctgaatgtctttccttccgcggtattttctgccccgatctatagtcccttgagtctccacacacactcctcacagagatctgtagcgtaggtacgtgacagctctgcctacatctgacgtccggagtcattaaccaggaatgtatgtgtgtctgtgtgtctctctgtggagtcgtcagaattcttcataggggttaagctaaaaaagcgaggcgaggagcccctctccaatggctcagttttgctgaataatcacgtgtgaatcgaggggcgggcttttggcaggcagatcttactagtatttactaccaagctctactccagattaaccatcccagtccttctgtcagtctccgatgccatcatgcagcctggttaggagcaaaggaaaggggaaaaagaaaaacgactaattcatcttttcctgatcgtcaggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacagga

SEQ ID NO: 83747 - DNA, 2832 bp, Homo sapiens
taaattttgctttaaatttaattgcttttctcctttttctctaataataggactatttcgcagtttccagtccttgattaattaaggcttcagagttcgttcttacatatgccatgtcttaagttttcataaaattcagtctacacaagacttgctttttgtgagcactgtgcttagtggcagtccggatttttccctccacccccgcggccacccctgcccaccgcgccgtcgggcatggatctggcaggtgcgaggccgaggcccagggctcagcgaaggacgccgagtttacagagcgcgcgcgccctagaggaggcagcagcagccgcaggcctggccgcccgaactttgcgagcctggcgggggagcacagaggcgggccgacctgccccgctagcgctgaggaacgactccctttatgccagctcgctgtccgccttcccgcagcgtacgctgcggagcctcaaagaccctgcggccctccacaaccgtcttaaataacaaacccctgtcctcgcccccgtaggaattggggcagctgggggttcgcgtcacagactcaagcccgccagcagaagggcaggccggacttcgcggggccgaaccccgctccagctggggacaggccgcctagccggcaggagggagccggcgcgagagacttgacgggaggaggtggagagcgggaggcgggaatgagggcgcgggaccgggcgggcggagcgtgcgagactgcgagcgcgagcgccagcagggcggagggcggggcgtgggcggcgcccggccttcccgctcccgcggcgctgcaactctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctaggggggggcccgccgcacgcccggcagcctccggagacgcgcgccgagcccggctcccacggcctctgaggctcggcggggctgcggctgcctggcgggcgggctccggagctttcctgagcggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggtgggtgaatgccttttcttccccctgaatgtctttccttccgcggtattttctgccccgatctatagtcccttgagtctccacacacactcctcacagagatctgtagcgtaggtacgtgacagctctgcctacatctgacgtccggagtcattaaccaggaatgtatgtgtgtctgtgtgtctctctgtggagtcgtcagaattcttcataggggttaagctaaaaaagcgaggcgaggagcccctctccaatggctcagttttgctgaataatcacgtgtgaatcgaggggcgggcttttggcaggcagatcttactagtatttactaccaagctctactccagattaaccatcccagtccttctgtcagtctccgatgccatcatgcagcctggttaggagcaaaggaaaggggaaaaagaaaaacgactaattcatcttttcctgatcgtcaggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacagga

SEQ ID NO: 83748 - DNA, 977 bp, Homo sapiens
gacccacgcgatgcggacccacgcgtccggcctggttaggagcaaaggaaaggggaaaaagaaaaacgactaattcatcttttcctgatcgtcaggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacagga

SEQ ID NO: 83749 - DNA, 748 bp, Homo sapiens
ggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacaggacaacatttttctgtgattttccctcctttagaacccatacacaacttatcacttgctaaggagaactgtactaaaagttattgaatgtcttaagtctttacactagaaaaggtagaccaactggaaaactagacatactctcttgatgattcagttgttttcatcctttacccatgtcccgtccaccttggtgcctagtatttctgctttaaaacaaaataaggacaactttttttttttttgaagattaagcctgaaatttcagtgtgaatttcccttaatgtccaatcttccctttttctcgacatta

SEQ ID NO: 83750 - DNA, 471 bp, Homo sapiens
tatacatgttgcacaaattctatcttattgatcaatttatcctacttttgggcccatttaagacgttccatcatagaagctcaatttttagaagttgtcttctactttcacctactagcacttttctgcatttgaccccttcaagccccatcctatgggtcttccgcaagaactccatcaaaaataaatagttacataaatggaaggacaggcagatattttaaaatatctctgtagcatatgcacttgaaggattctaccatttctacttcttttccaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgccctt

SEQ ID NO: 83751 - DNA, 821 bp, Homo sapiens
gaggaagtcgcgctcgtgccgcgcctgtcacaacagccgtccaggctcggggtcgtggccgtccagcacctccaactccacgataaagggaatctgtacgtcccgcttcagaaagcgccaaaaaggtttcttggattccagggcccagagcagccccatggactctagccccctaaagctgccgcccagcacgggcgcgcgctccaggtccagctcgccgcgggcgtcggcgcagtagcggaagagcccagccttctcgtcgcgcagggacgcgcgcgcagcgtgtccagcggctccgaagccaggccgcgcatggtgatgcgcaccggcttgtctcggcagccgcggcccgcgggctccaggatcagcgttgctgacatctcggagctggagcggggaatcttaaggtcgaggcccgaggcccgtccaagatcgtggcaagtgcgccgattgtccagagggcgtccggcgtcccctggtgccgggagcggccggtggctgagcagtcccagaaagcgcctgggactttagaccagttaacccggcgccctggactcgtctgaggcaaaaggagccagactcctctcctgggtcctctccttgggccccggggagcgcagacttttttttttttttttttcctttttttaattttgagacagggtctcgctctgtcgcccagcccggagtgcagtggccgatccatagctcactgtaatctcgatctcacaggctcaagctatcctcctgccttggccttccgagtatgtgggactacaggcatgagtcatcacgcctggcctaagccatcacgcctggcc

SEQ ID NO: 83752 - DNA, 711 bp, Homo sapiens
cgacaggggacggggtgaggctcccaacgctgagcgattccttctcgttcccgctggcgtggaagacgaggcttgtcttgacttcgaatcgtattaatatttcagacacttaacaggcaacctctcgtaggcattgactgcgtcccaggggctgtacctgtccgagctgattaagcgtgcgcggtcacccaggggtgaggaaacagggacggcgagctcgagtcactcggcagccggcagatccaggattcgaacctgtccaacaggccggacgcctacccccagctcacttaagtgcaagctcgcctgccgccgctggcgcacagacctcgtttgctttggcccaggtccttgctcggcacacggggcctccctgatacgcaggacccctgcctgtatttccaactgtatttcctactaaacttggcacaacctcactctgcaacagcttaattacttactgtttccggtcctcaccctcccccacctcaccgtacacctccgcattcaatctggactcctccacttcaacttcaccaccactcagatccaaacccgcactttattcctgggtacctgaaaaataactactagctggtcatcggtctccctccgctccactcgctcccatccacggggcaccgttttatgatctaaaaattgcacatcaaattatgctcacctccaccttgctcccgaaggcgcctatgg

SEQ ID NO: 83753 - DNA, 560 bp, Homo sapiens
gcgggttatctaaggaccccggggctcattcagaatttagatcttaagtgaatttgaaagggacatatcagatacatagtagatatagtaatataacaataatacacattgatcatgatttgggtgaattctctcagttgctctctctctttctctctctctctgtcactctatttcttctctcctctctctctctctctgtcttattcttcagtttgtgaatgtgcacatgtagaaacttaggaatctgtatgtgaatggttgttaaggtagcttgtcttgagagtttctttactacagcaatgactgataaaggatcactgccaaattgtggacacaaacacaaaaagagacaaaattagagagcaagagacaaaataaaatcgaagaaccagtgacaccaggtctactagggctgaattaccaaggaaaggatagcagttcaacacatttgcttcaagtctaccgcccagtagcctggagtaaatacactgggctattctcttttccttttcccaaataggatcggggggtgaactttttatttatagaagaaaata

SEQ ID NO: 83754 - DNA, 832 bp, Homo sapiens
gctggtacggtctggagagtagggaaaagccagaggctttggcaaggggcaggtacagatgtggctgagacagggccctggacgtttgctgagtgacgtcaggtcagctcgtaggaggcttccctgacttccagggtctcaccggcttccggtagctgagttaacccacctcaggtgctggaggccctccagctgtcagctggggtccgtgcaccccccagactgcctggagggttcgcacacagtttgaaaggcctctgcgctttggagcccaatttggaacttgaaggcttgacctttgtgttttggacaactgttttgtgtttaacctcagatggaggtgaccatccaaccagagtgatggtagcaggagctgggacggagccccggggctggcgcccagggacagggggccgaggcggatgggtggcgcagtccaggccagcatcggccccgtgggcctcggtttccaccgtctctacagcgtgggtggccccttcagttccgtgtggccttcgctagcgctgttgggcgctgagctgtacagctgccgtgtctgtgggcagaagttttttctcctgcaccgactgtgtcgtccagaggcgttcagagcctgctgttttcacgctctagccgcacagctgtgcccgcgagtgcgagtcccgcgtccgaggcctcggcgtgaccttacagcatctgtcgggtccgagcagtcagtccagagggtcgactctgaatgaaaacaaaacgccgtggtttgaaatggaaggaaacctggcccctgaagactttaaaaattcaaaaagcctttgctccctcaattacgacgatg

SEQ ID NO: 83755 - DNA, 407 bp, Homo sapiens
atttaaggagactggttgtaatttcttgattgggcctgctgggtggagtggcttaaagtagcatcagggcaaaaaaggtgttaggaattctatgtgatattaatattcatgcagttagttaagaagataaatgtttttatttttcttttgagcacaataacaagagctagacaaaaccgaatacattctgtgtacaccaaacttctatgagaagctaaaaaacacttttgatttcttctttctcatcatacctgaatttcatcctttggatgtgcttttacagtaaaatttctattaaattgaaattttaatattcgttcagacctaaattataagattttgtggtatgtattagtctcatctgtttaagatggtgcctaatgcagataatgcatcagtacagctct

SEQ ID NO: 83756 - DNA, 182 bp, Homo sapiens
tatatatactaaaaaacgggcattttcacatattctatgatctcttaaataatcagaagactagctgtgttcttaagttggcatcaatgggcacaagccagtttggtcatcctgtttcccgcctaacaccttagccagaactaagatctagggagagagcagttttgaagtagagatgggat

SEQ ID NO: 83757 - DNA, 753 bp, Homo sapiens
gcagaagtggagaggtgggtatgggacacacagggaagctgctctcttctgttgtctgtggcttctgttggaggatgtgctgtgggaatgcaaggaggagatggaaggaaggtgtcaatatagctttaacaaaggaaaaaaaaatgaaaacaccgaaaccacccttgcaaaaattgtaacagtgagaaaattatgacattgaaagatatccaatctaacccaactccttcttgcctttaacctccaaattgcacttagtcattcctgagcaaaggccaagctaactttgggagaaatttcgtttacagtttaaatgataatagcccttcccaaaactaacctgtctttgtaaaaatgatgaaaggccaccaggttagggaggatgagaggggcctgaatgcaggcttagataaacaattacccgccattgtttcagaggtcacaagatttgtaacttccccaattagtcctgtaaaatgatatcactgtggccttttgagatgtctttgcagttattttttgttttgtttgctttgagacaaggtcttgctctgtcaccaaggctggagtgcagtgatcatagctcactgcagtctctatctcctgggctcaagtgaaccttccacctcagccttccaagtagctgggactgcaggtgcatgccaccatgcctggccagttttgttgttttttggttctggggtgttttttgcttgtttgtttgttttgtttttgtatttttagtagacatga

SEQ ID NO: 83758 - DNA, 790 bp, Homo sapiens
aacagccagctcctaggagctgagggcctcagtcagtcatacatgcaccaggaatggaattctacctgctagtgagcatggaagaggaccctgagccttaggtgagactgcagcctctgctgtcacctggatttcctcctagtgagactacaggcagaggccccacctacctgatgtttagactcccaacccacagaaatggttttgtaaaccataggttctgggtccaggaatggggaggacgctggtggctcccacctggatttcatgccgcaagggctttctgctctggccttaactcacatggcatttttaaggcatggcaaatgttcttgcctttaaatggcagcattatatttcaaaggaaaatgtaataaagcatgcttttgcagcctcatggaaacgtgtgctatgcaaacatggacgatcctcatctgaaagtaattctctcccaactcctcaggccaccaagggaatgaaatcaaaagatgggcagcggttcctagctcatcatttgtcaaagcgagacgaagctcaaagcttcagacttttgtgtcctgcgctaaatttagctaatcgcacctctgcgttctgttcgccatccaggacccctgccatccccgggaaggactatcggcagtgacagcaataatgacactttgtgctttcggttcctcgccttggatggctttcaaaggcctctgccaccctgacgttccccatgtctgtgacacccagccaagcaggcacaggaggaggactctgtgctggcttcacagaagcaggaggg

SEQ ID NO: 83759 - DNA, 748 bp, Homo sapiens
gccatcagaggccaggattcttgccatccttcggaaacacgccctagccagaggaggtgcgctccctgcagttggaatctccggctgaggcgatgagagcccgccgggctcacctggcggtaaggccatcgcaggtgcgcctcctgcaaagcctcgagctgcacacgcgcccaggggaaagacgtgacgttgctgcacctgtggctagtccctgcgcctgtgtgtgagacctgagtggggctgtggagacccgagaggctgtggctcttgaggtgggtcggtggtggacgtggcctttgcttctgttctgaccttgtagccttggggccccttgagaccttggagaacaccttgctcaccgcctccctccgactgcagccatgtggacctagagatgagggcagaggatcaggtagcgttcatggtttttcccttgtaacttaatgtttaaataatttcagacttatagaaaagtccccagaatagtacaaagaactgtgtgtctggtacccgcattttcctttattaacatgtttctttctttaaaaaatatttttggcgaaccacctgacagtagcagacttatgccttttcttccatatacttttgtatgcatttggggcattcttttattatataaccatagtacagtgttcaaaatcagaaacttaacattgatataattctgtttttcaatctaaagattttattcatattcaccagttgtcccaattatgtccttaatagc

SEQ ID NO: 83760 - DNA, 379 bp, Homo sapiens
aactttcagactgataggaaagctgaatgctgtctctgtgcactgcctctaccctatctttcttcaaattgctgttcaggtcaacaaagacatacttattgatagatctaatagttaattttctgctgcttatctgctaaatacgattctaaccatcctcctacttgctgcaactctttctttcattggcttccaggttatcacccaatcctgattctccgtccccctgtctctgtgtgttcttagtctgttttgcctgctccagctctgcctgcccctcctgggttggcatccccaaggccctgtctttgattctcctgtctcacacacttcagggttatcagcttccatcctggcttcaattcctactctattcatg

SEQ ID NO: 83761 - DNA, 699 bp, Homo sapiens
gagccaagatcatgccactgcactgcagcccgggaaacaaaagtgaagctctgtctcaagaaaggaaaaaaaaaacaaaaaacaggtgaaatctgaatggggtcttgagttcagttaatagtaactgccaatgttggttcttagttttgacacataccatgactatgtgagatgttaatgtcaggggaaccaggatgaaggctatacagaactgtactatttttgcgacttctctgtacatctaaaattatccttaaaaaggtttctttaaaaaatgacatcttgttttctgtaaaatttgaatttctcatgagtgaaatggaacgttttgaatatgatgctctttttaaaaggtggccttaataatttgtatttactaaggaaaaaagtcagagtttatttactttaaaaaaattcaggccgggcgtggtggctcatgcctgtaatcccagcactttgggaggctgaggcgggcggatcacgaggtcaggagatcaagaccatcctggctaacatggtgaaaccctgtctctactaaaaatacaaaaaatgagccgggcgaggtggcaggcgcctgtagtcccggctactctggaggctgaggcaggagaatggcgtaaacccggggggtggagcctgcagtgagcagagattgcgccactgcactccagcctgggggacagagcgagactccgtctg

SEQ ID NO: 83762 - DNA, 200 bp, Homo sapiens
cagcagagcagctcgcagccgtccagcgcgggcgacgagctgttacaggcgcgccctgccgtgcctgctgtgcccaggcgtccgctgtacgtgcagaagttgggcgatttctcgaagtagacgaggtcgtggggggagggcggtttgtgggccgggtcttccggctccaggcgcagcagctccgcccgcgaagcgcggtt

SEQ ID NO: 83763 - DNA, 637 bp, Homo sapiens
attatgtcctcacatggcagaagagtaggagagagtgaacccactctcgcatgcctgttatccataggagtatgaatccatgtatgagggcgaaatggattagtcccatctctagatactattgcattggggattaaatttccaatatctgggtttggaagggaacaaaagcatttaaacctactgccctactcatccgtgtatcctagaatgggatctggcatctagtttttgctcaaaaaatatttgttgaatggacaactaaataaaagaatgtttactagagaaaatggactggagttgggtgtgagaacttacagactaattgtaattcggctaagcccggcaagaaagagagaatcctgcaagtgaggggtgcaggaaagatcagacgagttagtaaaagggagaaaaacaagagcccagtggtttaaaaataatctctgtgcttatccatcgtcataagggtggctgtcagtcatcagtggttgtccactgtggtttcagcctctgccagtagtggccacaacagtccctatcacatgagttagagccctcaagaacaacagctacttactgggagtctatggaaagctcctccactcaggcttccccacaatttatgctttaagagtat

SEQ ID NO: 83764 - DNA, 501 bp, Homo sapiens
attccactgttaaatctagctgaatgtagcctgcaacatggaagccatgaccaggacagtggaagtgcagtgtgaattatccaagcaatcatttcctcattccttgggtgggagtgggcagacacgcccaggagtccctcaccctgcctcccacgatgctctgcttcttcatacagtgcacacagtggtgggagatggcagcaggggcagagaggccctcattctggagaggggacctatgaatcttgtaaagaaaaaaaaaaaaaaaaaaaaaaaaaaaaaaaaaaaaaaaacaccccaccaaaaaaagaactagcatcaaacgaagagagacccccccgccagtgactgctataccccgctttcacactcatggcaaccacgcggcgcccaccatatcgcacacccactacctagatatcaacccaaaccctacggccaccgccggcatactaccccgtacggacactggcgccacaaaccaccacgctgccaaccatg

SEQ ID NO: 83765 - DNA, 526 bp, Homo sapiens
cgcatgttcccaggtggtacaggagctgcgactgcaaacacattcgtgggcaccgggtacaccacgtccacggctctgagcagtactccgactacagctaccgaccaacccccccaaatatcccagtaagcaggtatggccagccctttcagctcagcaggattgttctggagtcttatgtgaggtatcaacattcagactccagcagcattgttctggagtcctagtgaggggcaatcattcaggccctcatagcagtgttctggaatcctaagtgaggggaaatactcagaatccagcagcagtgttttggaatcctatgtgagggactaacattcagaccacagcaggaatgttctggaatcctatgttagggacagatattcagacccttgtggcagtgttctgtaatcctatgtgaggaagaaatattcagaccacagcagcagtgttgtggagtcctatgtgagggacaaacactcagaacccagcagcggtgttccggaatcgtatgtgagggacaaac

SEQ ID NO: 83766 - DNA, 810 bp, Homo sapiens
atagatcaggtgtcataaaatctgggggttcaggctgtggctcctccctctgcacccttgcgatgcaaattaacctattaccttaaaatgagatgtgaccaattctgctcagagacagaagctactggtcaaagggattcagagcaaaccagtcacagctaccagaggatttacagagggagctaacagagccgggctgggctgcagagcgacctttccacagcacgctgcaacctaatacagtgtgttaagccaggggacctacaggggagacacagattgggaaaggctgggcttggtaagcaggagaattggcccaaatgactcatcacataaggagagaatgaggcaggtaatcagaagctagcatctctaactaaggagatcaaagaaccagtgggatcaccttgctcagtgggaaggtgatctggataaataccaaagacggggacacttgcctgcagctgggcttttctgctcccagtgacagaatgccaaagtgagcctgctccatttaaagcataggccgggcgcaatgactcatgcctgtaatcccagcactttaggaggcccaagcaggtggatcacttgagtccaagaattcaagaccagcctgggcaacatgaagaaaccctatctctacaaaaaatacaaaaaactagctgggtgtggtggcacatgcctgtagtcacagctacttgggagactgaggcaggaggattgcttgagcccgggaggcagaggttgcagtgagctatgatggtgccactgcacactccagcctgggcgacagagtcagacattgtctca

SEQ ID NO: 83767 - DNA, 321 bp, Homo sapiens
actttagacaaataactcttatgaacatatatatatatgtatgtataaatctgcaacaaaattctagtgaaccaaagccagtgacgtataaaaaaaattatatactgtgaccacgtgggattaactccaggagtgcaaagttggtgtaagatacaaaataaatcaatgtaatataccatattaatacaagagagaacaaaagctatatgatcatctcaatagatgcaaaaaaaccatttcacaaaattcagcaccacttcatgataaaaacattcaacaaactaggaatagaaggggccttcctccatgcttaatggtgaa

SEQ ID NO: 83768 - DNA, 445 bp, Homo sapiens
gctaaatgtgttgcttgatatttaatgagtgaagggttctatgtaaaggcaattttccttccaaaagtactgtttattttcactggagacaaaattagacctttccagataccccatctctttttggtgaacagggttgaaagtgctgtggggtctatacttgaaaagttctcccaatatgcagttactgtttcccattcaatccctatacattgtactgtgttcatatctaattgtatcagatgaggtcagcttgccacttgatatagatcagagatgatcaaatgcacttatcctgtgaatacaactgcttgtgtacacatgtatataatatacatgcttgatttctacaattcacacgtaagtgtattatccaaataaaattgtacatattgtaaagtttatgttaaaaattaaatggtgatgatggtattaacacatggaa

SEQ ID NO: 83769 - DNA, 790 bp, Homo sapiens
ggatcagagtatcatgagtgagggcatcaggatttacccaaaggcccagagaggggacgcatcttgcttagggtcacagagcaaagtagtgcagggctgaggctagaactccaggcccctaactcccaaccagcagtcttcctgggaagctctctgaaatattccagcctatttaccaagtacctagcaagagcctcccgcggcccccactgggctcccccttgccctcaggggtcctaccataacggccatcttttggctcccaaaatgcctggggctccttcctaccacagggtttcttcttatgctgttccctctgcctggaatgctgttccccgtcctgtttgtcaagttagctccttccttgtcagatctcagctggaggatgcatccttagcaattcttcctcacctgtccagagtctgggtccaggaacttggttgtgccgtcccttctggcagcacgcactctgtgtggtgttcacattcccaactgcatctcttattagcatggaggacggagaccgagtctgctttgcttgatgctgtctctgcatccgcatggtgcctggtgcacagtaggcgctcaaggaagagcagggcaggtggggccccgcctcccagccccaaggagaagacagaggcaaatgtgttgctgggggaagcagaggcaccgaggcctgcaccagggagcccatcctagacaggtgccacccccacgctcggcctgccctggctccaggccccgccaacagcagagtgggggccctcacttgtgtctccctgcccca

SEQ ID NO: 83770 - DNA, 352 bp, Homo sapiens
gagctgatcgtggtcccacccaccccctttcctagctccatttcttccctgtgtccacttcctaatgtacctgctttgccccactgagacgtaaataaaccccaggaaccttcttcctaatcacacaggaccccagtgatctggggcaccttccccacatccagcctagtaatcagcctctcacccttcaaggtgggactcagcactctctgctaaatggaatcaccgttatctgctctgcttgtctttcctcctgggctgagaaagtcctggtcctatttagcaccataacttcagtgcccagcacactggagtgggccagtgatatctgttgactgcataaagaatgctg

SEQ ID NO: 83771 - DNA, 144 bp, Homo sapiens
aagccctgtctctaaaactgccccgggaggcccagcatgatggctcaaatctgtaatcccagcacttacgggggcaaaagcaggattctgcctgagccccaaaacttgagaccagcctgggcaatgtcatgagaccccattcct

SEQ ID NO: 83772 - DNA, 383 bp, Homo sapiens
cagtggccttatgggcagatgcaaccgtgcaccagtcgtcacagtttaacgcaaagatcaggggttaactttcagcctcactctgcagcctactgggtgcctttgtgcagggtggccctgctgggaagcacctgtgctgtcctctttctaaaatacgtaaataggaaaaagaaatgcaagatagggcctatcaaaaattcattagcataaaagtaggagacaaatgtcgctcatgagagatacaataagaatataacttcacaggcgatctactgcaggtgactttttgcatttttattatacaagcaattattcattgcaaaaaaataaaaataattagaaagggtgatcagaaaaaagaaaaaaaatccatggtctcatct

SEQ ID NO: 83773 - DNA, 380 bp, Homo sapiens
gtggatcctggggaacagaattctagcttagccaagttgacacagtagaaaaccacaataattattgttatttcactcagagaagtcacttgcttagtaggcttacatatcaggttaagtgtcataacccactttaaaaccctgtgcttgctcagtaatctcatcctgcctacaattaagtcccttagtttattcctctgtaatctgattccagtctagctttgtagacccacatctgagtgaccccttccatgcactctaggttgtaagaaaacatactctccaaacatttgtatgtggcttttcacctctggacgttgctaatattccttttcctttgcttgaaatgcttcctttccacttgcttctgcttgtttctc

SEQ ID NO: 83774 - DNA, 331 bp, Homo sapiens
cctcgcacacctacgtggtggtatcaagttctttctaaccacacgatattcaggccagtaatagtttagtgcacataatttctcatttgccaagtgtttgtaatttttcccggaaatctgaaaccttagatgttatctgagtacctccctgctgggaatagctttgaaggtcttaggcctctccaaacaggattcctctcttgatatgtgtcaaacacccaggagccaggttctgcaacctcactttctaaccatctccctgggaactcaacatacatagcgatgatgtttccacccattaaatgttagggtttcttttgtaaggcaccaa

SEQ ID NO: 83775 - DNA, 204 bp, Homo sapiens
ttcaggccctcgtcagctgtgtcctagattattgtcaaaacctcctaactgatctttgcccagtttctttagaacttgactttaacttgcctaagtttatgcagctagtgtcagagtcaggatacaaacctagctctgtatgagctaagcaatactgtttctgccaagtaacacctttcttattcatctttgtatctccagaat

SEQ ID NO: 83776 - DNA, 414 bp, Homo sapiens
tcacagtggaattgcctggccccagtgtttagtctgtattaggttgaaccacatgaaaggctggttaattcaacccttttttacctaggaaaatggcaacttcatatggttcaacctaatggagggagggattcttacatttattaaggacctactggacattcagtcattcatctaacacctgtagagcaatggctgtgtcagggccagtgtgtaacactgcttcagcaccccaagactgagagccaggatttttcatcttccctcctaaggataagaaacaaacttaccaggcagaacaagggtaaccaactcgatctgcctgagctcaggtaactactaaaacaggccaattttggccaggcatggtggcttcacgcccataatctcagcattttagaaggtcaaggcggg

SEQ ID NO: 83777 - DNA, 352 bp, Homo sapiens
gttaaaattgtctagaaatactttctccacccttactttccaaaatcaataagaggtcctttttagtgaactgtttccacagtctaccagagattcacaagcaacctaaaaaagttaatgcactttcagaatgcactcagaggttttgcgttttgcaggaagtagagatgggatgatacagttcttcgaaatacaggtgactcacctgtactacttagcataggcctgtaaggtatgccttaatttaataactacttgaaggaacctcagctatgatttggtccaacctcctaacttacagatatatttctcagagacttacccagaactacataaattattaatagtcagg

SEQ ID NO: 83778 - DNA, 704 bp, Homo sapiens
gagagagaatgagtgcccagcgaagggagaagctccttataaaaccatctgttctccttataaagatctcttaataaaaccgtcagagaactatctcattcactatcaggagaagagcatgggggaaccgcccccatgattcagtttactccacctggtcccgcccttgacatgtgggtgttattacaatttaaggtgagatttgggtggggacacagagccaaaccatatcacaaggctttctcctccttgctgggattgtacccatagcctctttctgagtcctctctcttttagcctctttatgcctgcagtgcatccttataccatttctagagtcatctttataaaacttatactctccgtatgactcataaatcctgtttttttttttgcacagtatattaagtataaaatttgttaaagtctttaatggtctgcccccaagctacatttccattttgtatgtctttcagttcctttctactttgtatttggctgttgagttaactgaatttttgccattccattaacccatcccatgcttttcccacttctagatttcacttttcttgtaggctagaatgtcttgactgggatctgactggagataatgagaacaaaaactggttcaaagagccaggatgttgcataaaagtcctaagattgtatctaagcaggtaaaataaaaattttaggcaatt

SEQ ID NO: 83779 - DNA, 893 bp, Homo sapiens
gaaagacagtttggataatcaggacaacatatcattagcaggacatttgaagcggtgcgtaatcgtgctaaaaatattaatttggaaagaatcttgaggcagccaaatttccattcgaatcctcacctccttttacaatagttttgggagcagggaaggatctgagagggaatgtgccatctctagcacttttttaatgacatacatgtattttttattccacaaagtgaatgcaggcttattgcagacaacttggaacataacggagaaaaatgaaatccataaacctaccccccaggggaggcctctgttaaccccatggtaggtcggctgttttcagcatgtgtgtgctttagaatacgttgattgaaatataacatatgtgcagaaaaatgcatggatcataaatgtatagcttgatggaattttcgggcaaaaactcccatgtaataagcatctggatcaagaaacggaacatatgaaagtgtgtgtttttttgtctttcaaattaaaaaagttttttagaaacagggtctcactctgtggcccaggctggagtgcagtggcacgggtatggctcactgcagcctccacctcctgggctcaagtgatcctcctcctttagcctcccaaggagctgggactacaggtgcacaccaccaagcctggctaattttttaattttttgtagagacagggtctggctatgttgcctaggctgatttcgaacccctggactcaagaggatctcctgcctcggcctcccaaagtgctgagattacaggcgtgagtcactgcacccagccaccaatgtggtttttaaacaaaatcagggccctatggtgttgtgagcccaattatattccccaaaaagatatgttgaaatcctcacc

SEQ ID NO: 83780 - DNA, 405 bp, Homo sapiens
gaactgtgaaacgctattccttgtccttgaggaattaaaagtgaagacagttacatttacatgtaaaaagataatatgaagagagacttttagaacagttcagtagaaccaaaacaagaaacgttgcaggccatacgcaaccatcaaatgaatgatccaagaaatcagacaaggaaacattcagtacagaatagatttgtctggggcacactctcaaaggaggcagaactcaggcaattctcaaggctgtgggtagtacctggaaaggcagaaaacaacaggcctgggaagagctggtatttaaaggggaaatttaaaggcccagggatgggaaagcaataaagtagacagtagccagggcgattttaaatcctcacacaagctcagaaacaccaagtcgtctca

SEQ ID NO: 83781 - DNA, 412 bp, Homo sapiens
  misc_feature (367)..(368): n is a, c, g, or t
gcattagcagtttagctctcaggtgatttcaatgtgcagccagaactgagaaccattgaaaaagaggcaagaaggccagacaagaaggtactgaattgaagtaatcaaaatatgaaattatgcactagggtagttacaattggaattgaaatttgaaaaatattttgagacaattgagctctctccctctctctctctcctgctgccttatgaagatatgccttgcctccccttcaccatccgccatgattgtaagtttcctgaggcctccccagtcatgtggaactttgagtcaattaaaccccttttgtttataaattaccaagcctcaggtagtatctttatagcagtgtgaaatggactaatnnaccacccttagcaccaacacatttttagcagcaattataatttc

SEQ ID NO: 83782 - DNA, 293 bp, Homo sapiens
agcaattctcctgcctcagcctcccaagtagctgggactacaggcacataccaccatggctggctaatttttttttttgtatttttagtagagatggggtttccccatgttggccaggttggtctcgatctcctgaccttgtgatctgcccgcctcggcctcccaaagtgctgggattacaggtgtgagccaccacgcccagccgcagcttagttcttattagttttggtaagttcttatgtgagtggtagctttagtggtgattatatgttttgtcagctgacagtagagaa

SEQ ID NO: 83783 - DNA, 380 bp, Homo sapiens
gaaataatacaaatttaaaaatacagtaaaactatttacatagcatttacattgtattattataattaatctagatattaaagtatatggaaggatgtgcataggttatatgcaaatactatgccattttatataagggacttgagcatccttggattttggtacctgcagggggtcctagaaccaatccccatggaaactgaggaagaattgacttttaatatattattgtagctttaaaaaaaagtgtagtcagtgatggttttcccttataaaaatactttgttttttgagaatggagctcatcttttataccttatcatattgactaagaaaaagatggtggtgtgagatactccttcacttgttagccctattca

SEQ ID NO: 83784 - DNA, 477 bp, Homo sapiens
tactgtaccttcttgaagatgaaagagtccgaaagatttaaagatttttgagcagaattagacataaaaaactgtcatagtttggtgttgctataatagaatatcacagacaaggtaatttataaagaaaaatttctttctcatagttctggaggctgggaagtccactgtcaaggtgctggcatttggtgagggccttcttgctgagtcagctcatggtggaaggtcaaagagagggcaagcgaaagcaggtgattgaacttgcagcctcacctcccattagaccctgcctcccaacagtgttgcattaggattattttcatcctatgctttttgtaggacatattcaaaccatacatagcacaacatacttgttaaaattttaaatcactgttaaagcatgtttctttgttatatgtggaaagcattgcctagtaataacttactagtcttaaggtagttttctgaaaaaaaata

SEQ ID NO: 83785 - DNA, 718 bp, Homo sapiens
gatcggcagtgacttcatgaggcctgaggcaatgacaaagagcccccagggtcttggtctgtcacccagcctggagtgcagtggtgggttcacagctcactgcagcctcaacctatgggctcgcgcgatcttcctatctcagccttccaagtagctgggactacaggcatgcaccaccacacctgggctgtctggtcctctgggcaggaacttgtggatgaagcaggtgttaatagggttccatcactggggcactgggaacccaccctgtgctgaggaagctatcatatgtcactaggaacaaagtgagcaaggtgctaagatctcccttcatatcctgttgggaaactgcttcctatgagaagaagaatccttcttggcttgagtcatgaagaaacggggagggctccgtgtgaacactattgaaagctctggacaacgctgggagggagtcttagttctaaaggtactagctgggtgaccttgagaacactgcctaatttctctcggagcccagcgtggggcctaagaggggctgggcatcagctttcaacctcgcttccagatgttctgagcactgttgttgggatggtcctgtttggcatgacagtgggtccattcttctgggaggggcaagggctggtgcacatctgtgcccctgtgccagcctgagacatctgtgatggcaaatcagactaggaaggtgatggaataaaac

SEQ ID NO: 83786 - DNA, 483 bp, Homo sapiens
ggcaaatggttggatatacctaggtcaacggccaagatctatttgttagagtgtgtgtcgaagttataactaacctcgcctactatctatacatttcaagacacattgccctccttcaagagagacagagtattatccaattgctgggaaaacaattggtaaactgtcctttataacatgtgacattgtaattggcatgaaattcacttattcattctaacttgatagatatttgtgttgtttcctttttgtttgtctggatatttatgaatagggctacgatgaacattctttcccagatcttttagtataaataagcattcagataagtgtagaaataaatgacaattaatgaatcgtgctgccaaattacttattgactcagtctgcgcccaagggaaaaacagaagccgcacagtaatttgaacaggaaaattacacagtttttaacatagaagatttaagtaatgcgggaattgcttc

SEQ ID NO: 83787 - DNA, 587 bp, Homo sapiens
agttcagcatttccttcttttccaaggctgagtaatattctattgtatgcatacaccacctttagcttatgccttcatctgtccgtggatacttgggctaatgctgctatggacatgagtatctcttcaacaccttgctttcagttctcacggatatatacatggaagttgaattgctggatcaaatggttacttttactttttcaagaaaccaccgtattattttccatagtgcctatatcattttatattcccaccagaatatacaaggactctgttttcttcacattctcaccaacacttgttatttctgtgtttctttctcttttttatttgtctatgtatgtatgtatttatttttggatagtgccatcctgatgggttgggtgtgattgctcattggaaggttttcatttttatttccctaatgagtaatgatgttgagcatcttttcttattcaagtcctgtgcccatttttcaattgggttatttttgttgttgttgacttgtataagttctttgcatattctggatagcagttgctttttcagatacatgatttgcaagtattttctcccactccgtg

SEQ ID NO: 83788 - DNA, 810 bp, Homo sapiens
cagaccacatgctattctcactctcaaatccaaagtgactgtcccagccaaaagtgatttttctttctctgccctattacagcactcagattataccattcatgtgttccctattacatgttgcttttattgtaattgtgaatcatacgagtgcctgctctattcagggactgtgctatgcacgtcacccatcctttctataattctcaaccagcctgcaagatgaataccatcatcagtggtgttcatggtctgtccaacatcgcacagctaataagaatggagcccggctctaaggctgtgtgtgtcactgcaaaccttgtgccctgcccattctagcagttgcctcactcacaattcctggttgtcttgtgcttctccatgagtatagtggtggccttgaccttatgtatcttggttccaaatgtaacatagatctacttagtgtcttcatgggctcagaacacatgacttaataataccttgtactcagtaaaggtggcatgaaggaatgcctgagatgtctctcttttcttttgtagtttatgctgaagcacatgatcagctctatttggtgtttatcaggagctgacaccttgatattcccaccatctcccaggctagttgctccctcgttcctggattagtaaattgtcctaactattctccttgcctggaatccaccctaccgtctgccaccaaacttatcttcataaatgtcagctaggtcacatattccagtaacatatagcttcaaatccctgaaagtcagtgtccttcattttgcctcatcacccccaccccatgacc

SEQ ID NO: 83789 - DNA, 386 bp, Homo sapiens
ccacgatcccgggtgttcagaagaggtgtgtgtttcttccttcctccctctcgtcacagttgctgtcccccaaggaagaggaaatgacttgcttgtggaatccgtttgcaagcaaatcacttatttggaaccaaaaatgggggagaaggaagtaggagccatagactcagggcttgatcaggattccgcaagccttagagttttccactccccacaacatacctctcacctgggccatttagaggcatctcctgcctcccactctgtctctgcctgaggtctacactccgcgcccccccaccaccccccagcccgacccccactttaacaggattcaactcctttgtctgactgtgaccacaggtgatgagagctgggagggcgag

SEQ ID NO: 83790 - DNA, 456 bp, Homo sapiens
gcccctgaattccttgacaggtggccactctttgacacgttagactccaacttgctcaccttcttccaactggcttcagttcattccattttgaccactgccatggttggcttctacatgatccccatttgtgtctcaacttggtctcctcagccaggagctctgagctgcctgttccttgcctttgatgtacctccatttcctgtaattaatctcagctttcccacagctcagcagtacatgacagacacaaggataaagcacccagttcgagccagctccagtgtctctccacttgtatccattcctcgtggtctgccactttggtaggcatcatcttaccccagaggtagcacatatgcatgccatgcagaaaacacaacactgacttctgttcaaagaaaatcaaaccgccagaaagtgaggtcatgcaagcaggcagctcgtcatattctc

SEQ ID NO: 83791 - DNA, 864 bp, Homo sapiens
ggccttgcaggagggggtgataggccctgcataaagggggcagcgatgagacggcagcaatgagacacaagctcttcagccccaaggccatagcacccctgagagtgagctccttccggaagcttctcaggctccctgaagctgctggggaactagaagcgttcagtctgggtcacctagcatgacaccccgggaagcacagccccagctctgactccgagctctgggggcgagagggggctctcgcatcagcacgtggcagtccctcaatgtcgaacccagaagagtgaagaaaaaccaagagacaacagccggcctcggtcctgagcccgaccggccttcggcattgaccccagcagcgccccgtggtgtggctgctgctacgcgaccccccgggggatgcggaggccctggggctgctgagcaagctgccacgtggtgcctgccatgctggggtctgaggccccccacctgccgtggccccgacacacatagcacatcatgggacctgcggttcacagaggattgtactcccaggggctctgccgaccctacaaccaacccccaccacgaggggcggcaaggacaggatcagcccactttgtgaatgaagaagctgaggcccagggacgtgaagggcacacgggggctggactcctggccaggaggtaaggggcgggcagggtctctgcagacggaaaagatggaaaggcgttcccggctgaaggagcagcgctgcggaaacagcaaggcctggagaccctctaaggctgccagccccctcgagggctgcagccacagaaggcgggggtgggggtggcgggggcaaggacccagagagggcctggggtcaaaggtcatcca

SEQ ID NO: 83792 - DNA, 446 bp, Homo sapiens
tagagaacctatattacttacctaactagagaacctatgttacttataataaatagatcctaaccacaaaaatatgtagcatgaaaagaaatcagtgtggaagttctaggtagctgagtccgctgcagaagttgctgcacctgggcgtgctgtctcctgtttggtgggaggacggcaggcagtaagaaaggcacagaccagcaccaaatgaagtctttctctgtgatgcggttagagggactgaaagagaattgaaaaggacatggcgttctccccaagtgaatgctttactcaatagtgtgcctatgtactacctaaaatcatgcatggctgcacccatgggatatgtcacgtttttggaaacactgtcctcattagaagttgggtgcccatggcctgaaagaattttcacccccactccatccccaggtgtggggagggggcag

SEQ ID NO: 83793 - DNA, 270 bp, Homo sapiens
gttattctggcaagtgctttcagggccctccagggtttggctggtcaccatggagggggggttcaggtgctgaatttagggaccccagcatctcacaggtttccccttccatctttcccagtggcactgtgtctgagcaggtgtgcccaggtgaggttgtatccactgtgtctgagcaggtgtgcccaggtgaggttgtatccactgtgtgtgagcaggtgtggctgttgcaggtggaagtggggatatgtgggcacctgggtgcccatg

SEQ ID NO: 83794 - DNA, 570 bp, Homo sapiens
  misc_feature (516)..(516): n is a, c, g, or t
  misc_feature (557)..(557): n is a, c, g, or t
ggagctggggccatcctccagggcaaaagaagctgagtcctgttcctccctctccacttgctaagcccacgcgaggtcttcgggggctggacaaagaagccagccttccccacactgttgtcagactgagcttctttaaaagtaaaactgactctgtcacttaccagctcaaccccctccagtgggcaaataaaatctaaactgttccccatggattccaaggtggcctggtgcaatctggccctacctgctctggcctgtcccattgctgtgccccccaccacgggtccctctgcttctcattcctgcctccgggcctttgcactgctgtgccctttgcctagaatgctcttccccctcctcccaatcattgaggggctgtttcctccccattattcaggtctctcactaaatgtcacctcctagagacaccttccctgaccccagtcttaatggctttcagtattttttctgtgcagtgcttctcactatctgatgtaatcttttctcttcaanccctttttatgttctgggttcagatttacactctgaacaanaggctcaattaca

SEQ ID NO: 83795 - DNA, 456 bp, Homo sapiens
cagtgagctgtgattgcaccactgcacactaccctgagcaacagagtgagaccctgtctcaaaaagaaaaaagaaaataataattctatagcccatcatgcctcaaacatacctagtggattaggtgtctcagttggggtttcagaatgtatgtccaccacttcatctttctgtaagatgtaggccaaaggatacaatgtagcaaatatgtagttgaacaagtcaaaagatctaatgtacagcatgaggactatggttattaacagtgtattgtattcaggctttttatgagtagattatagctgctcttgccataggggcagtgagactgcataactctgtgagatgatggctatgttaatttattctactatactaaccattttattatatgtatatatcttataacatcatgttgtatatcttaaatatacacaataaaatgtattttaaaaa

SEQ ID NO: 83796 - DNA, 708 bp, Homo sapiens
caacggtcccccagccatgggcgctgcagctccggccgagtccgcagacctcgggaacttctggaaggcgggagaacccctgctgcaaggccccgacgccctggcggctcccatgagcaggtcacccagcacgccccagaccacgccatctccccagggtcgccagagtccctggcccctgaggtccctgactcagagccatattcagtacttccagtgggggcgcccggtgcccagcacccacctcatcgaggtgcggcccacccaggaccccgccaagccgcagcgggtggtctccgagggctggaggcgccctgcccttcccggggagaccgctctggggcgagacctctcctgtgcctgggagggttgcatgaaaggggggctgtgtcgtgcctggaacccaggacggacctggagcccggtgaccatcgggatcgcgccccctgagcgtcaggagagcccctggagatcccctggacagagagcccgccccgcaggccgccccgccgcccaggagctcctggacccctgcacccgggagactctgctgggggcgctcagccagtgccccaagggaagcgctaggttcgacgggccgttgtggttcgaggtctcagacagcaagggtggcaggcggaacctgcagccccggccctctgccttcaagcccctgagcaaaaatggagcggttgcttccttcgtgcc

SEQ ID NO: 83797 - DNA, 3305 bp, Homo sapiens
  misc_feature (2)..(3): n is a, c, g, or t
anncgggggcgggctactgggcctgcgctgccgggctttgggttctgggcctctgccgctctctggccctaagtgctgagctgccgggaacggcagcttctgacgctgggccattggacgctgcggaaccaggcttcttcactttgagtttccgccgcgaagcgccagtccgggccgaggagggagcctttactacttctccctggtttcattcatgttctgaggagggtgtgagaaggaaccatggatcccacagccttggtggaagccattgtggaagaagtggcctgtcccatctgtatgaccttcctgagggagcccatgagcattgactgtggccacagcttctgccacagctgtctctctggactctgggagatcccaggagaatcccagaactggggttacacctgtcccctctgtcgagctcctgtccagccaaggaacctgcggcctaattggcagctggccaatgttgtagaaaaagtccgtctgctaaggctacatccaggaatggggctgaagggtgacctgtgtgagcgccatggggaaaagctgaagatgttctgcaaagaggatgtcttgataatgtgtgaggcctgcagccagtccccagagcatgaggcccacagtgttgtgccaatggaggatgttgcctgggagtacaagtgggaacttcatgaggccctcgaacatctgaagaaagagcaagaagaggcctggaagcttgaagttggtgaaaggaaacgaactgccacctggaagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggatattcaggaagtgttaaacaggagcaaatcttggagcttgcagcagccagaaccaatctccctggagttgaagacagattgccgtgtgctggggctaagagagatcctgaagacttatgcagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccacagaggcttggaattgggcctggcccccatggggcttggaggaccgagccactgacaggtatcccctgaaactgagctgagcccagtatccaaggattcctctgtctgatcctttggtctttgctaccaggctgaagtctgtcatgaaaccacttattttaaaaagcagaggcccagtcaaatgagcattgcatcccatgagggaagcacgacagggctgatggtgaggatcagagcagttctaaggtgactcgttggggtaaggatcaggactttgtccatgtagtagccaaccaccctcttccctgattcccgtccggtgtcacagttcagtcagtgaggatgatgaagtagatacagtcttcaggacaccattagatgggctttcccaataggccaaaaaaatgctgcgcatacccagagctggttgttgtgctgaggccagtcagaggatgcttcccctgaggtttgctataactaagcaacctttatgtgactctcaccttctgacctcctggcaagagaaattcagtgcagcagggggacacagacctgcccaagccaccccactgccgttccctctctgagcacaagctgggcaaatcactgtcccttggactccagtagaccagtgtcctagtcttgccttttttctctaagtggcaggatcagaaaacctgcgagctttagtttgtattttcactttatgaatgaggaaactgaaatggccttaagggagcaagttatttctttttttttgacacggagtctcgctctgttgcccaggctggagtgcagtggcacgatctcggctcactgcaggctctgcctcctgggttcacgccattctcctgcctcagcttcccgagtagctgggactacaggcgcccaccacgacgcctggctcatttttttgtatttttagtagagacggggtttcaccatgttagctaggatggtctcgatctcctgacctcatgatccgccctcctcagcctcccacagtgctgggattagaggcatgagccactgcgcccggcccctggagcaagttatttcttacaaagctgctgaaggtaagattatcaaaattataaagcatttttcacactcaagtgaaacaaggttgacaaactcacttcgcaggtcacatgcctatacatcacttattatatttgggtctgaaacttctcacatgtttgggaggttttatgtgtcctcattgggaaaatgggtgtaattcagcataaaacctcatatgattgtcctgcctcatggagctgttgtatagatcccagatccatcccatgatttgttcctgtctgaggcatagaggcaggcaagccgtggattttgcacatggtgactttcccactgtgccatgatacagtctgcatcttatagcagtgcctttgtctcagggcctctgctggcagtctagaccttttgggcagaaaggagcttcaaatggctgtgataaggaatattaaaaattgtgtttctactttaattgtattggctgttcatgtatgtaggagttaaaataggccaaactggagaaataaacgcattctgtccaccatg

SEQ ID NO: 83798 - DNA, 419 bp, Homo sapiens
ttttagtagagacagagtttctccatgttggtcaggctggtctcgaactcccgacctcaaaccatccgcccaccttggcctcccaaagtgctgggattacaggtgtgagccaccatacctggcccatttttacttttttaaaaccaagggaatagaggaaaatactatgaaactaaaagtttaagcttagctggaataatttatttgaaacaatttagaaaatgaaggtcatgtaacttttgcaagacctttgaaaattaacaaacttaattacaactttgcatttcattgccaagcataagaaggagttttactaaagctatgtaaataattgcattaggatatatagcagagacattctatatatatgtatatatatgtttaatttattttcctttttttttttctgagacaggatc

SEQ ID NO: 83799 - DNA, 533 bp, Homo sapiens
tgaggaaaggaaagacagattttctgttctagttaatggattttaaaaatggcagttcaggaggttcagcagggtatttcaggtcacatagtgagttgctgagaaagctgatttagagctcacggatagaggactattttgttggctcaatagattggtaggaagatgacttaccaatcctagatttgggaggcagacgttcatcctctccctctttctctcggattcgctgccagtaatacacaatgggctctgtgccagaggatgactcacactgcaaagtcaggtcacttccttctgtcagctctccttccaactcacacttgggcttggatggtctcactggcaacagcaacaacaagcaaaagtgtagtgattcaaagatccccaaacaccagattcaatggaaaaattatgtcctattgagttgcttctccagccatctgttttggtcaacttttgagtggggattcaactagccttgctttacactacccccaccaaaacatccacctccatcccctaagcacaca

SEQ ID NO: 83800 - DNA, 331 bp, Homo sapiens
atttagcatatatttgttcattggaaataatgcttgaaacaaaataaatatcatttggtgacaaaacacactctattacagaaacagccccaggatcggggaggcccctgcagctgtggtctgagtggcattttgccagtgctgggagcccgtggtgggaggatgggcctgcgtgagcccttcggtggtccggctgcaagtgcttccgtgggggatccagacccagtacagttacacggtatctcatgctagcgtgggtcacgttagagtgagtttctacttcctaatgttaatgaattaatttcactctgtttatactttcttatattct

SEQ ID NO: 83801 - DNA, 167 bp, Homo sapiens
ggatcccaagctaaatgttaagtcagtaattccacttgggaggaaccccagcatgggcctggcaccaggcaggaaacagtgatgaaataaaagctttctgtatcccagccgggcgtggtggctcacgcctgtaatcccagcactttgggaggccgaggtgggtggat

SEQ ID NO: 83802 - DNA, 470 bp, Homo sapiens
tccacctcgtccgtgttactctacaatgacaggccacaatgaggacacagagtcagcagagggccaggcagctgttcacctctcccatcacacccaggtaaaactccagctcatgttggcccacctcctggaaaagtctctctgtcaacagcatttcaggatctcgtattcagaagacaacagctttagcgaggagggcactgtgactgcaggtgggcatctgtgcttccgcccgtgtgggacccctgggacacttacgctgggggaggatgtggttagtggccacacaaatgcctaaatccaaagacattggaaagtgaattaattcactaaaaaataggttgtttctttagtgaataaaataacttagatactcctggatacttcattgagtcatattttggatgtttatttttatttattgatgttcctataccacagggatggacacggtggctcacacctgtaat

SEQ ID NO: 83803 - DNA, 600 bp, Homo sapiens
aaggaaaactgcacacttgtccaaccctccaccttgcaggcaggccctttgccaccggagtccactcccgtccccagaccagccagctccctgcacccagagccccagaccacacagcccctgcacccggaaccccagaccagccccctgcacccggagccccagaccagcccctgcgcctggaaccccagaccacacagccccctgaacccagagccccagaccagcccctgcacccggagccccagcccacacagccccctgcactcggagccccagatcacacagcccctgcgcccggagccccagaccagcccctgtgcccggagccccaggaccgcaggaggctgccctgctcctggcacacagtggtgctggggaaggagcctgtgggccacactgctgtctgccaggctggggctggggctggggctccagggtcccccaggggtggggagatggagctgcctccatggtcctgggcacctaccagcacctagcagagtgtggagaggcttcctcagaggctgaggcgggcgtgtgcttggcctcctcagggcccttgccgcacatcggtcccctcaccgcccagcctgttcc

SEQ ID NO: 83804 - DNA, 131 bp, Homo sapiens
acgttgagggtaagagtgggtgagaaactttctgtcagagaataaagtggtattttggccaggaactaaagatatgatggtatttcaacagttggagacctagatggagacaggaatagcctaagcaaagg

SEQ ID NO: 83805 - DNA, 397 bp, Homo sapiens
agtttataaaaattacacgatggtcagaggcaaaaggaagagatggacaattttttacccctcaatttaagataattatagggaagtcatagattttgtcataatgccatttctgaaaataacacttttagaagttatgaaggcagtacttattcattaaacaaaataaggaaaatatagaaaaacataaagaaaatggaaataatctacagttctcctaaccaaagcgaggcattgtaaacatatatagtacattcccctctttctaacctcaagttgctttgtgtctatggatgtgccataatttttttaactaccccccttaccccatgaacatttaggttgtttctcctgcccgcccccccgcattttgctattatagacaataattcataga

SEQ ID NO: 83806 - DNA, 1799 bp, Homo sapiens
cgagactgcagagggagtagtgcgatcctgcgcgcgggggaactagctggagggcaaggcgggaacaccatctattgttggggtgatcggacctaacaccaggttgtggggacaacgaagtccagaagagtgaaaggaatgagaaaagacagtttgagagagaaagtgggcccagggggccaatgcgagtatggaggctgtgaaggccccgagccctggaagcccagactatttattggtgatcaaacaaagaaacagggggaatattgtcctattatgattctcctgaagatgcctggaaaggttgcaaagggagcatacaaatggcagtctgtgaaattgaagttcattctgtagataatacatgcatggacctgataatccccggggaacagtatttctacctgaaggccagaagtgtgcctgaaagatagcggcggctggtggccctgggatcagccaaggcttgcctgactgacagtaggacccagaaggataaagagtttgctgaaaacactgaaaacttgaaaaccaaaatgtcagaactaagactctgctgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagattgcaaatgcagccttcacctctgagctgctctaccacactccaccaggatcaccacagctggccatgctcaagtccagcaagatgaaacatcctattataccaattcataattcattggaaaggcaaacggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataaccgtccaaggtgaaataatgaaggaagatagaatggaaaacctgaaaaatcatgacaataacttgtctcagtctggatcagactcaagttgctctccagaatgcctctgggaggaaggcaaagaagttatcccaactttctttagtaccatgaacacaagctttagtgacattgaacttctggaagacagtggcattcccacagaagcattcttggcatcatgttgtgctgtggttccagtattagacaaacttggccctacagtgtttgctcctgttaagatggatcttgttgaaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggaaaaggatatccagacagccctgaataacgcatatggtaaaacattgcggcaacaccatggctgggtagttcgaggggtttttgcgttagctttaagggcaactccatcctatgaagattttgtggccgcgttaaccgtaaaggaaggtgaccaccggaaagaagctttcagtattgggatgcagagggacctcagcctttacctccctgccatgaagaagcagatggccatactggacgctttataagaggtccatgggctggaatctgatgaggttgtatgatggctgctgggcagcacctcctaacttcagggaataaagtgctaaagtgta

SEQ ID NO: 83807 - DNA, 745 bp, Homo sapiens
cgagactgcagagggagtagtgcgatcctgcgcgcgggggaactagctggagggcaaggcgggaacacgccactgtgagcatgcatttcaggttgttggcgcagctctgctccatgatgtcgatctgaaacccagattttccttctcttgccactgtcatctcctgcatggccaaagctaggtcaccatcatagtcatgtttcagcctatgggaagggggaaagacaatattcaagcatctattgttggggtgatcggacctaacaccaggttgtggggacaacgaagtccagaagagtgaaaggaatgagaaaagacagtttgagagagaaagtgggcccagggggccaatgcgagtatggaggctgtgaaggccccgagccctggaagcccagactatttattggtgatcaaacaaagaaacaggtggtgagaatgtggggttgaaagggagcattgcattaagcacatgatttacagctgtgatggtttagcatatgctctgctacttgagataatggagagcaggttcttttaactcaagatacaatagatcctgggagagcagggagcaaggagccagccagcctagacacattccagaggccatgagccctggattctttccaagccacaaggggttttatgccctgggcttagattatggtgcatcagggtagccttccaccctttggcgcagagcttggtgttccaaaggccacgaggggttttagacccaggatcc

SEQ ID NO: 83808 - DNA, 1701 bp, Homo sapiens
cgagactgcagagggagtagtgcgatcctgcgcgcgggggaactagctggagggcaaggcgggaacaccatctattgttggggtgatcggacctaacaccaggttgtggggacaacgaagtccagaagagtgaaaggaatgagaaaagacagtttgagagagaaagtgggcccagggggccaatgcgagtatggaggctgtgaaggccccgagccctggaagcccagactatttattggtgatcaaacaaagaaacaggataatacatgcatggacctgataatccccggggaacagtatttctacctgaaggccagaagtgtgcctgaaagatagcggcggctggtggccctgggatcagccaaggcttgcctgactgacagtaggacccagaaggataaagagtttgctgaaaacactgaaaacttgaaaaccaaaatgtcagaactaagactctgctgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagattgcaaatgcagccttcacctctgagctgctctaccacactccaccaggatcaccacagctggccatgctcaagtccagcaagatgaaacatcctattataccaattcataattcattggaaaggcaaacggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataaccgtccaaggtgaaataatgaaggaagatagaatggaaaacctgaaaaatcatgacaataacttgtctcagtctggatcagactcaagttgctctccagaatgcctctgggaggaaggcaaagaagttatcccaactttctttagtaccatgaacacaagctttagtgacattgaacttctggaagacagtggcattcccacagaagcattcttggcatcatgttgtgctgtggttccagtattagacaaacttggccctacagtgtttgctcctgttaagatggatcttgttgaaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggaaaaggatatccagacagccctgaataacgcatatggtaaaacattgcggcaacaccatggctgggtagttcgaggggtttttgcgttagctttaagggcaactccatcctatgaagattttgtggccgcgttaaccgtaaaggaaggtgaccaccggaaagaagctttcagtattgggatgcagagggacctcagcctttacctccctgccatgaagaagcagatggccatactggacgctttataagaggtccatgggctggaatctgatgaggttgtatgatggctgctgggcagcacctcctaacttcagggaataaagtgctaaagtgta

SEQ ID NO: 83809 - DNA, 398 bp, Homo sapiens
cgaggcgcgcagaaggaagtcggcaggcgagactgcagagggagtagtgcgatcctgcgcgcgggggaactagctggagggcaaggcgggaacacgtgagtgcgggagtggactgggttccctgagcattgatcccaaacagggcagcttttcgttccaaggtcgtctgtggacacacactgtggcttgctttgttttaacgtctgatactggagaggagggaaatgctgctgcagcacaactgcagaaccctggaaggcgaactcgtttgaatggcttttaaaggcgacgtggagctaataatggggggatcttaaattactctagctccgaagtgggaaagtggaatctgtacgggtaggttaagattacggtggagtcggggtgggaggagaggc

SEQ ID NO: 83810 - DNA, 1641 bp, Homo sapiens
gtgggcgtgggctgagtggccgtgggcgccatggagtgggtgctgtacaagtggaccaactatctgagcagttggcagccttgatggttctttctctgtaggggaatattgtcctattatgattctcctgaagatgcctggaaaggttgcaaagggagcatacaaatggcagtctgtgaaattgaagttcattctgtagataatacatgcatggacctgataatccccggggaacagtatttctacctgaaggccagaagtgtgcctgaaagatagcggcggctggtggccctgggatcagccaaggcttgcctgactgacagtaggacccagaaggataaagagtttgctgaaaacactgaaaacttgaaaaccaaaatgtcagaactaagactctgctgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagattgcaaatgcagccttcacctctgagctgctctaccacactccaccaggatcaccacagctggccatgctcaagtccagcaagatgaaacatcctattataccaattcataattcattggaaaggcaaacggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataaccgtccaaggtgaaataatgaaggaagatagaatggaaaacctgaaaaatcatgacaataacttgtctcagtctggatcagactcaagttgctctccagaatgcctctgggaggaaggcaaagaagttatcccaactttctttagtaccatgaacacaagctttagtgacattgaacttctggaagacagtggcattcccacagaagcattcttggcatcatgttgtgctgtggttccagtattagacaaacttggccctacagtgtttgctcctgttaagatggatcttgttgaaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggaaaaggatatccagacagccctgaataacgcatatggtaaaacattgcggcaacaccatggctgggtagttcgaggggtttttgcgttagctttaagggcaactccatcctatgaagattttgtggccgcgttaaccgtaaaggaaggtgaccaccggaaagaagctttcagtattgggatgcagagggacctcagcctttacctccctgccatgaagaagcagatggccatactggacgctttataagaggtccatgggctggaatctgatgaggttgtatgatggctgctgggcagcacctcctaacttcagggaataaagtgctaaagtgta

SEQ ID NO: 83811 - DNA, 291 bp, Homo sapiens
gactcttttaaatcattcaacagtcacttctacccagaagcagatgaaaggatgaaggggcacttttccctgggtcagcagaacagcaccttatcagcaccattatgtgatctgaagggactaggattaaaacccttaagcatcctgccctccagggaaatgtggaaacctgaagcagccccttataacagaaagactctagaaaagtaaagctggtttcagtgggatttctgtggttttctccattgatttttcatttccacctccaagagccttttattgccaagtatt

SEQ ID NO: 83812 - DNA, 264 bp, Homo sapiens
ttcaggtggcctccaggagggcagtttccagagatgaatttccttccccttgcccagcccaccactgcccagccctgtgggctctgaggctgacggagagagacctgccacaccccgggacactctggatcgaagccacccagcgtcagagcttggacgatcaaggtggacctacccgctcagaaagacagtggcgcttctgtcaagggagacctcaacgaccttcctctgaaaagaaaaatgtccttgcaagtaggtaaatga

SEQ ID NO: 83813 - DNA, 564 bp, Homo sapiens
  misc_feature (418)..(418): n is a, c, g, or t
  misc_feature (447)..(447): n is a, c, g, or t
  misc_feature (452)..(452): n is a, c, g, or t
  misc_feature (466)..(466): n is a, c, g, or t
  misc_feature (484)..(484): n is a, c, g, or t
  misc_feature (512)..(512): n is a, c, g, or t
  misc_feature (527)..(527): n is a, c, g, or t
  misc_feature (538)..(538): n is a, c, g, or t
aacttgattctataattgatttgacaaaagaaggcctatccaactgcaatacaggtaaaaggattttttagatctttcttttgtaaaaaggagggaagggtaacaactcataatgcactgggtctacttatgaagtttgttttaatatgtgagtgtgcctatgtttatatctctgtgcagttttagctcatgtgcagattcatgtaactgccgtcacagtgacaaagctccttcatgctacccctttatactcacaccttgtttctgccccaatccctggcagccaccaatctgttctgtactataattgttatttcacaaatttacataaatttgataatgcagtatgtgtccttcggagattgacttcttccgaggggtcatccacattcttgtgtaacagtaggtgtgtgttccnctttattgccaggaggaggcccgtgggtntgggntggcatcataattnctttaattcataaacccnttgaagggcatctgggcttgttgggggnctttttacacatttnattttcttccngtgggggacatacttttttccccaac

SEQ ID NO: 83814 - DNA, 588 bp, Homo sapiens
catcatttgtatatagtgaggagtttttaaaaattcattttggcaggcaaatcacaatcatggtcatcagccatcgaaatacatgtgatttaacttatgttttgccatatgtatgcaagaatactttgaaaatgctaattttgtttggaaggatacaattggtaaaattcccttcaactgcttttttctcacctatttaataggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaaggtaggtgtttctgcaaaaatgcataaatttatctaaatctataataatgaattttttcttcatcacagttttggatctttgtaatattgattattcttaacattcactcttaaaatgtcctatagttttacttttacatattatacttcagttgtgggggttttttttggtttttgggttttctggtgttttttgagatagggtctcactttgttgtccaggctgga

SEQ ID NO: 83815 - DNA, 2874 bp, Homo sapiens
  misc_feature (2576)..(2576): n is a, c, g, or t
taagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaaggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaagtaacaatgatgatgttatgttgatttctgtggaaagtcctaatttgacaactccaactacatcaaatccaacagataccagaaaaattacatcaggaaattctagcaattctcccaatgctgaagttatggctgtacagaagaaacttgattctataattgatttgacaaaagaaggcctatccaactgcaatacagaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagaccaaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacacaaaaacataatgtatcttatgaaagcattacccaacctgtttgagttgagaatgcatttgtccacctttgatttgaggctttagtttgctgatttcctaaatgctaccctttgatcatttcctggccaccatcacaatactaaggggctcagatgtgtcttgtgcccacctcttcctgagaagagatggaagtggagctgtgactagtacaagcagcccaagaaactctgaacgggacccaatggaggcaaacttgagcaaataattgggatgataagaaacaaaaataatcccaactgtttgaaagttcgaaagaggggcattcttttctggtacatggtgagagttcaggctccagagactcaaaacggaatggttttccttggcattttgtaaatgctctcacatctgtagcaataaagctgttattttctgcaaaaagtgatggtgaggaagaggatggagatgaagatgaggaagctgagtcagctacgggcaagcgggcagtgaagatgatgaggatgacgatgtcgataccaagaagcagaagacgagaggatgactagacagcaaaaaaggaaaagttanactaaaaaaaaaagggcgcgtgacctattaccctccaattccgctcttaaaattctaaaacgtggtgcgttcatttgaagaagggccgcccgcccacgggggagtggcacccgagattgaaagcgctttcaacaccaaccaaactgtggattgcccgggggaaaagaccaactccaggccggttttcttaagtctaaaggaatgcggttttcactatttgactggggggcttagttggaacccgggttgcatctgagggggctcggaactaaagaatccctttttttgtgaattggta

SEQ ID NO: 83816 - DNA, 2970 bp, Homo sapiens
  misc_feature (1489)..(1489): n is a, c, g, or t
aaacctgctctcctaggagacctgaaggctgcttccgctaacccgggctggcgctgctaacctcacccaacgatccctgctgtcggaaaatgtccagaggcaccatccctgctatgaagagggaatgccagtacaacagccacaaggggtcttcctgtggccctcaaacaaaaaatcactgcattacatcagcagactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaatttaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgatttttttttttttttttaatctggcccaaattcctatctaaggggcctggggagtcatgcccaacaaaccataaattctcatcagatgagttttatttaaccctatatatggtgacttgctttccagtctgactctggcatgacatgtgacaaagaagaaagtcaaaatattttaccccaaaacatgtttctttgccatattttgaaatggtcctgcaaagctgtgctttgtgggggaaaatatgcatctgtaaagaatctctattaacacagctagatctttttcttccaggccctcccaatcctgaagagactgagagtctagcattgttttaaaggtctgaataggaaacatttgtcatctatcatctctaagggtagccattataagacttcaaaagaaccttttgaagtattataatcttttatcttaacctgaacatgtgcttcctattgatcccaggtcttcagacaattgtgaactcaaccatttgtcaattagaaaatgtttaaattggctgggcacagtgtctcatgcctctaatcccagcactttggaagaccaaggcgggcagattgcctgacctcaggagttcgagaccagcctgggcaacatggtgaaaccccgtctctactaaaatacaaaaatttagccgggcgtagtggcatgcacctgtagtcccagctacttgggaagctgaggaaggagaattgcttgaacccggcgggcngaggttgcagtaagcagagatcgtgccactgcactccagcttgggcaacaaagtgagactccatcacagaaaaaaaaaagaaaatgtttacctttacctatagcctggaaatccctgctttgagttgctccatctttctgaaccaaaccaatgttatttcttaaacgtatttcattgatgtctcatgcctccctaaaatgtataaaaccaagctgtgccccgaacaccttgggcacatgttctcaggacctcctgagggccgtgtcacgggtcataatcactcatatttggctcagaataaatctcttcaaacattttacagagttgactcttagtcaacatgtccatacctgatgagatgcttcatcaaaattctagtggactggctagttcagaaaatggaccagccaggtttgcttaaatgcacccctgcacaactatctcactcctgcttggagccggctagatcaggagacctgtccctaaactaatgtactccatgtcttaagtctttttgttttgttttgtttttgtttttgacagagtctcagtctgtcacccaggctggagtgcagtggcgtgatcttggctcgctgcaacctccgcctcccaggttcaagagattctcctgtctcagcctcccaagtagctgggacaacaggtgtgcaccaccatgccctgctaatttttgtgttttaagtagagatggggtctcaccctgttggccaggctggtctcgaattcctgacctcaggtgatccacccacctcggcctcccaaagtgctgtaattacaggcatgagccaccgcacccagcccatgtgtcttggtcttttttactaatattgattataaaatggatgaaactttggataaaatttctgcgttagaatttctttttatatctgtcctaaagcttgtaactacttgctcatgattttttgtgtatgtttagcaatgtgcatgtcattgatggcctttgtaaagtatgttcaattgagttgtggagacagaggtgcaattggagtaggttgtaagaataaaaaggagtaggcaaaaaggcacgggtataccagtggacttcaaagggtactcagactttgttcttaagggatcaattcccagatcttcagtttcatataaactctttcctaaaattgacttgcctaaaagcatgttagtgttgtgggcacagcttctcttttcttatttctgcttttacagtcatcctttttccaaaaggaaggtatacatctcctccttgtctaacaatggcacattgccccagggtgtaaaagaggccaggggtgacaagcagagacacaattcaaagcatttgtattaagagagcagtaactccaatgcattattttgcaagtcacatttttttgtttttgtttgttttgagacaggatctcactctgttgcccagcgtggagtgcggtggtgcgatctcagctcacaatcactagtgaattcgc

SEQ ID NO: 83817 - DNA, 2077 bp, Homo sapiens
aaacctgctctcctaggagacctgaaggctgcttccgctaacccgggctggcgctgctaacctcacccaacgatccctgctgtcggaaaatgtccagaggcaccatccctgctatgaagagggaatgccagtacaacagccacaaggggtcttcctgtggccctcaaacaaaaaatcactgcattacatcagcagactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaatttaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgatttttttttttttttttaatctggcccaaattcctatctaaggggcctggggagtcatgcccaacaaaccataaattctcatcagatgagttttatttaaccctatatatggtgacttgctttccagtctgactctggcatgacatgtgacaaagaagaaagtcaaaatattttaccccaaaacatgtttctttgccatattttgaaatggtcctgcaaagctgtgctttgtgggggaaaatatgcatctgtaaagaatctctattaacacagctagatctttttcttccaggccctcccaatcctgaagagactgagagtctagcattgttttaaaggtctgaataggaaacatttgtcatctatcatctctaagggtagccattataagacttcaaaagaaccttttgaagtattataatcttttatcttaacctgaacatgtgcttcctattgatcccaggtcttcagacaattgtgaactcaaccatttgtcaattagaaaatgtttaaattggctgggcacagtgtctcatgcctctaatcccagcactttggaagaccaaggctggtctcgaattcctgacctcaggtgatccacccacctcggcctcccaaagtgctgtaattacaggcatgagccaccgcacccagcccatgtgtcttggtcttttttactaatattgattataaaatggatgaaactttggataaaatttctgcgttagaatttctttttatatctgtcctaaagcttgtaactacttgctcatgattttttgtgtatgtttagcaatgtgcatgtcattgatggcctttgtaaagtatgttcaattgagttgtggagacagaggtgcaattggagtaggttgtaagaataaaaaggagtaggcaaaaaggcacgggtataccagtggacttcaaagggtactcagactttgttcttaagggatcaattcccagatcttcagtttcatataaactctttcctaaaattgacttgcctaaaagcatgttagtgttgtgggcacagcttctcttttcttatttctgcttttacagtcatcctttttccaaaaggaaggtatacatctcctccttgtctaacaatggcacattgccccagggtgtaaaagaggccaggggtgacaagcagagacacaattcaaagcatttgtattaagagagcagtaactccaatgcattattttgcaagtcacatttttttgtttttgtttgttttgagacaggatctcactctgttgcccagcgtggagtgcggtggtgcgatctcagctcacaatcactagtgaattcgc

SEQ ID NO: 83818 - DNA, 2144 bp, Homo sapiens
  misc_feature (1489)..(1489): n is a, c, g, or t
aaacctgctctcctaggagacctgaaggctgcttccgctaacccgggctggcgctgctaacctcacccaacgatccctgctgtcggaaaatgtccagaggcaccatccctgctatgaagagggaatgccagtacaacagccacaaggggtcttcctgtggccctcaaacaaaaaatcactgcattacatcagcagactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaatttaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgatttttttttttttttttaatctggcccaaattcctatctaaggggcctggggagtcatgcccaacaaaccataaattctcatcagatgagttttatttaaccctatatatggtgacttgctttccagtctgactctggcatgacatgtgacaaagaagaaagtcaaaatattttaccccaaaacatgtttctttgccatattttgaaatggtcctgcaaagctgtgctttgtgggggaaaatatgcatctgtaaagaatctctattaacacagctagatctttttcttccaggccctcccaatcctgaagagactgagagtctagcattgttttaaaggtctgaataggaaacatttgtcatctatcatctctaagggtagccattataagacttcaaaagaaccttttgaagtattataatcttttatcttaacctgaacatgtgcttcctattgatcccaggtcttcagacaattgtgaactcaaccatttgtcaattagaaaatgtttaaattggctgggcacagtgtctcatgcctctaatcccagcactttggaagaccaaggcgggcagattgcctgacctcaggagttcgagaccagcctgggcaacatggtgaaaccccgtctctactaaaatacaaaaatttagccgggcgtagtggcatgcacctgtagtcccagctacttgggaagctgaggaaggagaattgcttgaacccggcgggcngaggttgcagtaagcagagatcgtgccactgcactccagcttgggcaacaaagtgagactccatcacagaaaaaaaaaagaaaatgtttacctttacctatagcctggaaatccctgctttgagttgctccatctttctgaaccaaaccaatgttatttcttaaacgtatttcattgatgtctcatgcctccctaaaatgtataaaaccaagctgtgccccgaacaccttgggcacatgttctcaggacctcctgagggccgtgtcacgggtcataatcactcatatttggctcagaataaatctcttcaaacattttacagagttgactcttagtcaacatgtccatacctgatgagatgcttcatcaaaattctagtggactggctagttcagaaaatggaccagccaggtttgcttaaatgcacccctgcacaactatctcactcctgcttggagccggctagatcaggagacctgtccctaaactaatgtactccatgtcttaagtctttttgttttgttttgtttttgtttttgacagagtctcagtctgtcacccaggcttgggcaacaaagtgagactccatcacagaaaaaaaaaaagaaaatgtttacctttacctatagcctggaaatccctgctttgagttgct

SEQ ID NO: 83819 - DNA, 2081 bp, Homo sapiens
  misc_feature (1489)..(1489): n is a, c, g, or t
aaacctgctctcctaggagacctgaaggctgcttccgctaacccgggctggcgctgctaacctcacccaacgatccctgctgtcggaaaatgtccagaggcaccatccctgctatgaagagggaatgccagtacaacagccacaaggggtcttcctgtggccctcaaacaaaaaatcactgcattacatcagcagactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaatttaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgatttttttttttttttttaatctggcccaaattcctatctaaggggcctggggagtcatgcccaacaaaccataaattctcatcagatgagttttatttaaccctatatatggtgacttgctttccagtctgactctggcatgacatgtgacaaagaagaaagtcaaaatattttaccccaaaacatgtttctttgccatattttgaaatggtcctgcaaagctgtgctttgtgggggaaaatatgcatctgtaaagaatctctattaacacagctagatctttttcttccaggccctcccaatcctgaagagactgagagtctagcattgttttaaaggtctgaataggaaacatttgtcatctatcatctctaagggtagccattataagacttcaaaagaaccttttgaagtattataatcttttatcttaacctgaacatgtgcttcctattgatcccaggtcttcagacaattgtgaactcaaccatttgtcaattagaaaatgtttaaattggctgggcacagtgtctcatgcctctaatcccagcactttggaagaccaaggcgggcagattgcctgacctcaggagttcgagaccagcctgggcaacatggtgaaaccccgtctctactaaaatacaaaaatttagccgggcgtagtggcatgcacctgtagtcccagctacttgggaagctgaggaaggagaattgcttgaacccggcgggcngaggttgcagtaagcagagatcgtgccactgcactccagcttgggcaacaaagtgagactccatcacagaaaaaaaaaagaaaatgtttacctttacctatagcctggaaatccctgctttgagttgctccatctttctgaaccaaaccaatgttatttcttaaacgtatttcattgatgtctcatgcctccctaaaatgtataaaaccaagctgtgccccgaacaccttgggcacatgttctcaggacctcctgagggccgtgtcacgggtcataatcactcatatttggctcagaataaatctcttcaaacattttacagagttgactcttagtcaacatgtccatacctgatgagatgcttcatcaaaattctagtggactggctagttcagaaaatggaccagccaggtttgcttaaatgcacccctgcacaactatctcactcctgcttggagccggctagatcaggagacctgtccctaaactaatgtactccagcttgggcaacaaagtgagactccatcacagaaaaaaaaaaagaaaatgtttacctttacctatagcctggaaatccctgctttgagttgct

SEQ ID NO: 83820 - DNA, 1651 bp, Homo sapiens
aaacctgctctcctaggagacctgaaggctgcttccgctaacccgggctggcgctgctaacctcacccaacgatccctgctgtcggaaaatgtccagaggcaccatccctgctatgaagagggaatgccagtacaacagccacaaggggtcttcctgtggccctcaaacaaaaaatcactgcattacatcagcagactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaatttaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgatttttttttttttttttaatctggcccaaattcctatctaaggggcctggggagtcatgcccaacaaaccataaattctcatcagatgagttttatttaaccctatatatggtgacttgctttccagtctgactctggcatgacatgtgacaaagaagaaagtcaaaatattttaccccaaaacatgtttctttgccatattttgaaatggtcctgcaaagctgtgctttgtgggggaaaatatgcatctgtaaagaatctctattaacacagctagatctttttcttccaggccctcccaatcctgaagagactgagagtctagcattgttttaaaggtctgaataggaaacatttgtcatctatcatctctaagggtagccattataagacttcaaaagaaccttttgaagtattataatcttttatcttaacctgaacatgtgcttcctattgatcccaggtcttcagacaattgtgaactcaaccatttgtcaattagaaaatgtttaaattggctgggcacagtgtctcatgcctctaatcccagcactttggaagaccaaggctggtctcgaattcctgacctcaggtgatccacccacctcggcctcccaaagtgctgtaattacaggcatgagccaccgcacccagcccatgtgtcttggtcttttttactaatattgattataaaatggatgaaactttggataaaatttctgcgttagaatttctttttatatctgtcctaaagcttgtaactacttgctcatgattttttgtgtatgtttagcaatgtgcatgtcattgatggcctttgtaaagtatgttcaattgagttgtggagacagaggtgcaattggagtaggttgtaagaataaaaaggagtaggc

SEQ ID NO: 83821 - DNA, 2642 bp, Homo sapiens
  misc_feature (1587)..(1587): n is a, c, g, or t
aaacctgctctcctaggagacctgaaggctgcttccgctaacccgggctggcgctgctaacctcacccaacgatccctgctgtcggaaaatgtccagaggcaccatccctgctatgaagagggaatgccagtacaacagccacaaggggtcttcctgtggccctcaaacaaaaaatcactgcattacatcagcaggccggacgcggtggttcatgcctgtaatcccagcactgtgggaggccgagacgggcggatcacgaggtcagcagatcgagaccatcctggctaacacgactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaatttaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgatttttttttttttttttaatctggcccaaattcctatctaaggggcctggggagtcatgcccaacaaaccataaattctcatcagatgagttttatttaaccctatatatggtgacttgctttccagtctgactctggcatgacatgtgacaaagaagaaagtcaaaatattttaccccaaaacatgtttctttgccatattttgaaatggtcctgcaaagctgtgctttgtgggggaaaatatgcatctgtaaagaatctctattaacacagctagatctttttcttccaggccctcccaatcctgaagagactgagagtctagcattgttttaaaggtctgaataggaaacatttgtcatctatcatctctaagggtagccattataagacttcaaaagaaccttttgaagtattataatcttttatcttaacctgaacatgtgcttcctattgatcccaggtcttcagacaattgtgaactcaaccatttgtcaattagaaaatgtttaaattggctgggcacagtgtctcatgcctctaatcccagcactttggaagaccaaggcgggcagattgcctgacctcaggagttcgagaccagcctgggcaacatggtgaaaccccgtctctactaaaatacaaaaatttagccgggcgtagtggcatgcacctgtagtcccagctacttgggaagctgaggaaggagaattgcttgaacccggcgggcngaggttgcagtaagcagagatcgtgccactgcactccagcttgggcaacaaagtgagactccatcacagaaaaaaaaaagaaaatgtttacctttacctatagcctggaaatccctgctttgagttgctccatctttctgaaccaaaccaatgttatttcttaaacgtatttcattgatgtctcatgcctccctaaaatgtataaaaccaagctgtgccccgaacaccttgggcacatgttctcaggacctcctgagggccgtgtcacgggtcataatcactcatatttggctcagaataaatctcttcaaacattttacagagttgactcttagtcaacatgtccatacctgatgagatgcttcatcaaaattctagtggactggctagttcagaaaatggaccagccaggtttgcttaaatgcacccctgcacaactatctcactcctgcttggagccggctagatcaggagacctgtccctaaactaatgtactccatgtcttaagtctttttgttttgttttgtttttgtttttgacagagtctcagtctgtcacccaggctggagtgcagtggcgtgatcttggctcgctgcaacctccgcctcccaggttcaagagattctcctgtctcagcctcccaagtagctgggacaacaggtgtgcaccaccatgccctgctaatttttgtgttttaagtagagatggggtctcaccctgttggccaggctggtctcgaattcctgacctcaggtgatccacccacctcggcctcccaaagtgctgtaattacaggcatgagccaccgcacccagcccatgtgtcttggtcttttttactaatattgattataaaatggatgaaactttggataaaatttctgcgttagaatttctttttatatctgtcctaaagcttgtaactacttgctcatgattttttgtgtatgtttagcaatgtgcatgtcattgatggcctttgtaaagtatgttcaattgagttgtggagacagaggtgcaattggagtaggttgtaagaataaaaaggagtaggc

SEQ ID NO: 83822 - DNA, 2865 bp, Homo sapiens
  misc_feature (1810)..(1810): n is a, c, g, or t
aaacctgctctcctaggagacctgaaggctgcttccgctaacccgggctggcgctgctaacctcacccaacgatccctgctgtcggaaaatgtccagaggcaccatccctgctatgaagagggaatgccagtacaacagccacaaggggtcttcctgtggccctcaaacaaaaaatcactgcattacatcagcaggccggacgcggtggttcatgcctgtaatcccagcactgtgggaggccgagacgggcggatcacgaggtcagcagatcgagaccatcctggctaacacggtgaaaccccatctctcctaaaaatacaaaaaaattagctgggcgtggtggcgggcgcctgtagtctcagctactcgagaggctgaggcaggagaacggcgtgaacccgggaggcggagcttgcagtgagccaagatcgcgctactgcacttcagcctgggcgacagagcgagactccgtctctctctctctcacgctctctctctatatatatattccatagactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaatttaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgatttttttttttttttttaatctggcccaaattcctatctaaggggcctggggagtcatgcccaacaaaccataaattctcatcagatgagttttatttaaccctatatatggtgacttgctttccagtctgactctggcatgacatgtgacaaagaagaaagtcaaaatattttaccccaaaacatgtttctttgccatattttgaaatggtcctgcaaagctgtgctttgtgggggaaaatatgcatctgtaaagaatctctattaacacagctagatctttttcttccaggccctcccaatcctgaagagactgagagtctagcattgttttaaaggtctgaataggaaacatttgtcatctatcatctctaagggtagccattataagacttcaaaagaaccttttgaagtattataatcttttatcttaacctgaacatgtgcttcctattgatcccaggtcttcagacaattgtgaactcaaccatttgtcaattagaaaatgtttaaattggctgggcacagtgtctcatgcctctaatcccagcactttggaagaccaaggcgggcagattgcctgacctcaggagttcgagaccagcctgggcaacatggtgaaaccccgtctctactaaaatacaaaaatttagccgggcgtagtggcatgcacctgtagtcccagctacttgggaagctgaggaaggagaattgcttgaacccggcgggcngaggttgcagtaagcagagatcgtgccactgcactccagcttgggcaacaaagtgagactccatcacagaaaaaaaaaagaaaatgtttacctttacctatagcctggaaatccctgctttgagttgctccatctttctgaaccaaaccaatgttatttcttaaacgtatttcattgatgtctcatgcctccctaaaatgtataaaaccaagctgtgccccgaacaccttgggcacatgttctcaggacctcctgagggccgtgtcacgggtcataatcactcatatttggctcagaataaatctcttcaaacattttacagagttgactcttagtcaacatgtccatacctgatgagatgcttcatcaaaattctagtggactggctagttcagaaaatggaccagccaggtttgcttaaatgcacccctgcacaactatctcactcctgcttggagccggctagatcaggagacctgtccctaaactaatgtactccatgtcttaagtctttttgttttgttttgtttttgtttttgacagagtctcagtctgtcacccaggctggagtgcagtggcgtgatcttggctcgctgcaacctccgcctcccaggttcaagagattctcctgtctcagcctcccaagtagctgggacaacaggtgtgcaccaccatgccctgctaatttttgtgttttaagtagagatggggtctcaccctgttggccaggctggtctcgaattcctgacctcaggtgatccacccacctcggcctcccaaagtgctgtaattacaggcatgagccaccgcacccagcccatgtgtcttggtcttttttactaatattgattataaaatggatgaaactttggataaaatttctgcgttagaatttctttttatatctgtcctaaagcttgtaactacttgctcatgattttttgtgtatgtttagcaatgtgcatgtcattgatggcctttgtaaagtatgttcaattgagttgtggagacagaggtgcaattggagtaggttgtaagaataaaaaggagtaggc

SEQ ID NO: 83823 - DNA, 3009 bp, Homo sapiens
  misc_feature (1489)..(1489): n is a, c, g, or t
aaacctgctctcctaggagacctgaaggctgcttccgctaacccgggctggcgctgctaacctcacccaacgatccctgctgtcggaaaatgtccagaggcaccatccctgctatgaagagggaatgccagtacaacagccacaaggggtcttcctgtggccctcaaacaaaaaatcactgcattacatcagcagactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaatttaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgatttttttttttttttttaatctggcccaaattcctatctaaggggcctggggagtcatgcccaacaaaccataaattctcatcagatgagttttatttaaccctatatatggtgacttgctttccagtctgactctggcatgacatgtgacaaagaagaaagtcaaaatattttaccccaaaacatgtttctttgccatattttgaaatggtcctgcaaagctgtgctttgtgggggaaaatatgcatctgtaaagaatctctattaacacagctagatctttttcttccaggccctcccaatcctgaagagactgagagtctagcattgttttaaaggtctgaataggaaacatttgtcatctatcatctctaagggtagccattataagacttcaaaagaaccttttgaagtattataatcttttatcttaacctgaacatgtgcttcctattgatcccaggtcttcagacaattgtgaactcaaccatttgtcaattagaaaatgtttaaattggctgggcacagtgtctcatgcctctaatcccagcactttggaagaccaaggcgggcagattgcctgacctcaggagttcgagaccagcctgggcaacatggtgaaaccccgtctctactaaaatacaaaaatttagccgggcgtagtggcatgcacctgtagtcccagctacttgggaagctgaggaaggagaattgcttgaacccggcgggcngaggttgcagtaagcagagatcgtgccactgcactccagcttgggcaacaaagtgagactccatcacagaaaaaaaaaagaaaatgtttacctttacctatagcctggaaatccctgctttgagttgctccatctttctgaaccaaaccaatgttatttcttaaacgtatttcattgatgtctcatgcctccctaaaatgtataaaaccaagctgtgccccgaacaccttgggcacatgttctcaggacctcctgagggccgtgtcacgggtcataatcactcatatttggctcagaataaatctcttcaaacattttacagagttgactcttagtcaacatgtccatacctgatgagatgcttcatcaaaattctagtggactggctagttcagaaaatggaccagccaggtttgcttaaatgcacccctgcacaactatctcactcctgcttggagccggctagatcaggagacctgtccctaaactaatgtactccatgtcttaagtctttttgttttgttttgtttttgtttttgacagagtctcagtctgtcacccaggctggagtgcagtggcgtgatcttggctcgctgcaacctccgcctcccaggttcaagagattctcctgtctcagcctcccaagtagctgggacaacaggtgtgcaccaccatgccctgctaatttttgtgttttaagtagagatggggtctcaccctgttggccaggctggtctcgaattcctgacctcaggtgatccacccacctcggcctcccaaagtgctgtaattacaggcatgagccaccgcacccagcccatgtgtcttggtcttttttactaatattgattataaaatggatgaaactttggataaaatttctgcgttagaatttctttttatatctgtcctaaagcttgtaactacttgctcatgattttttgtgtatgtttagcaatgtgcatgtcattgatggcctttgtaaagtatgttcaattgagttgtggagacagaggtgcaattggagtaggttgtaagaataaaaaggagtaggcaaaaaggcacgggtataccagtggacttcaaagggtactcagactttgttcttaagggatcaattcccagatcttcagtttcatataaactctttcctaaaattgacttgcctaaaagcatgttagtgttgtgggcacagcttctcttttcttatttctgcttttacagtcatcctttttccaaaaggaaggtatacatctcctccttgtctaacaatggcacattgccccagggtgtaaaagaggccaggggtgacaagcagagacacaattcaaagcatttgtattaagagagcagtaactccaatgcattattttgcaagtcacatttttttgtttttgtttgttttgagacaggatctcactctgttgcgcttgggcaacaaagtgagactccatcacagaaaaaaaaaaagaaaatgtttacctttacctatagcctggaaatccctgctttgagttgct

SEQ ID NO: 83824 - DNA, 2544 bp, Homo sapiens
  misc_feature (1489)..(1489): n is a, c, g, or t
aaacctgctctcctaggagacctgaaggctgcttccgctaacccgggctggcgctgctaacctcacccaacgatccctgctgtcggaaaatgtccagaggcaccatccctgctatgaagagggaatgccagtacaacagccacaaggggtcttcctgtggccctcaaacaaaaaatcactgcattacatcagcagactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaatttaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgatttttttttttttttttaatctggcccaaattcctatctaaggggcctggggagtcatgcccaacaaaccataaattctcatcagatgagttttatttaaccctatatatggtgacttgctttccagtctgactctggcatgacatgtgacaaagaagaaagtcaaaatattttaccccaaaacatgtttctttgccatattttgaaatggtcctgcaaagctgtgctttgtgggggaaaatatgcatctgtaaagaatctctattaacacagctagatctttttcttccaggccctcccaatcctgaagagactgagagtctagcattgttttaaaggtctgaataggaaacatttgtcatctatcatctctaagggtagccattataagacttcaaaagaaccttttgaagtattataatcttttatcttaacctgaacatgtgcttcctattgatcccaggtcttcagacaattgtgaactcaaccatttgtcaattagaaaatgtttaaattggctgggcacagtgtctcatgcctctaatcccagcactttggaagaccaaggcgggcagattgcctgacctcaggagttcgagaccagcctgggcaacatggtgaaaccccgtctctactaaaatacaaaaatttagccgggcgtagtggcatgcacctgtagtcccagctacttgggaagctgaggaaggagaattgcttgaacccggcgggcngaggttgcagtaagcagagatcgtgccactgcactccagcttgggcaacaaagtgagactccatcacagaaaaaaaaaagaaaatgtttacctttacctatagcctggaaatccctgctttgagttgctccatctttctgaaccaaaccaatgttatttcttaaacgtatttcattgatgtctcatgcctccctaaaatgtataaaaccaagctgtgccccgaacaccttgggcacatgttctcaggacctcctgagggccgtgtcacgggtcataatcactcatatttggctcagaataaatctcttcaaacattttacagagttgactcttagtcaacatgtccatacctgatgagatgcttcatcaaaattctagtggactggctagttcagaaaatggaccagccaggtttgcttaaatgcacccctgcacaactatctcactcctgcttggagccggctagatcaggagacctgtccctaaactaatgtactccatgtcttaagtctttttgttttgttttgtttttgtttttgacagagtctcagtctgtcacccaggctggagtgcagtggcgtgatcttggctcgctgcaacctccgcctcccaggttcaagagattctcctgtctcagcctcccaagtagctgggacaacaggtgtgcaccaccatgccctgctaatttttgtgttttaagtagagatggggtctcaccctgttggccaggctggtctcgaattcctgacctcaggtgatccacccacctcggcctcccaaagtgctgtaattacaggcatgagccaccgcacccagcccatgtgtcttggtcttttttactaatattgattataaaatggatgaaactttggataaaatttctgcgttagaatttctttttatatctgtcctaaagcttgtaactacttgctcatgattttttgtgtatgtttagcaatgtgcatgtcattgatggcctttgtaaagtatgttcaattgagttgtggagacagaggtgcaattggagtaggttgtaagaataaaaaggagtaggc

SEQ ID NO: 83825 - DNA, 1828 bp, Homo sapiens
cctccacaacccacactgcccccacatccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83826 - DNA, 762 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacaggtaccgccgcgcagcccgccgccgccagccccgggaccccggcttcctgcccagccgccgcctcccttctcctccgccctcagccccggagtgttcccggcaggacgaaaccgccgcaaagttgctggctggccgcagccgggcgtgtttctgcctgcgtcagctgccgccccgccgccccccagagtgcagggatggggcagccgggcagagcccgggccctcggccggagctctcgttcctgcttccgtctcctcgtccttcctcttgctctcacggcgaagggccggcgggcggagcagctgcggcggggccgtgtgggggtggggagccggttcccctgggggttccaggcgggagtccggggcgcagcggcatcgtggggagctgccccggcctctggcggcccggaaccccaggaagcaggggctccgaggcggggatactgcggcctccgcccggctcctccgccgcccgccccggccccggccgccacgctgagcctatttttaggcctttg

SEQ ID NO: 83827 - DNA, 2096 bp, Homo sapiens
gccacaaagattgcaggtgtaacccagagttcagccgtctttaggaagattaaactcctacccagctgtcattggtctttcttggtcatttgtaatgttggctagtctggtgttctaacctgtgttctatcccttatttaatcttggaaatcatccatatccttgcttccagaaatccttgaatcctgctcaccttattacatttttctccatgatcgcctggaacctggacttcatttgagttagatgatcattcattttgcctagcttaagtatttttggtacagattgacagcgatgttacccatgttataatgggctgaagataatagaagcaagtacaggcggatgttgatgggcctgtcaagggacaggtgccactgttcagagctttcctagagtatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83828 - DNA, 1988 bp, Homo sapiens
  misc_feature (1938)..(1938): n is a, c, g, or t
  misc_feature (1943)..(1944): n is a, c, g, or t
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgtacngatgnnggccagcccttctttctcctcttctatttattcccgtttttttt

SEQ ID NO: 83829 - DNA, 1982 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggaaacaaataggcccagtttctgataaatgcatccatggttaccaggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83830 - DNA, 1809 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83831 - DNA, 1118 bp, Homo sapiens
agttcgacggagactctcccaggaggtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83832 - DNA, 1134 bp, Homo sapiens
agtgatatagtgaattttcaatataaacacaattaatcctagtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83833 - DNA, 1133 bp, Homo sapiens
  misc_feature (34)..(35): n is a, c, g, or t
agggcctgctcgcgaccgctgagtcagatgaacnntacacgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83834 - DNA, 1716 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83835 - DNA, 1079 bp, Homo sapiens
cacacccttctcctgcctcagcctcccaagtagctgtgattacaggtttggtgcaagtgccaaagttgtgcatttcctgggacgagtcaaaccatggaattatacttatgatcccaaaacagtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83836 - DNA, 930 bp, Homo sapiens
gtaaataagagaaaattcatgcgcgtcaccagcgtgtgaccggcatagaacctagtagaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83837 - DNA, 1084 bp, Homo sapiens
cacacccttctcctgcctcagcctcccaagtagctgtgattacaggtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattattgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83838 - DNA, 515 bp, Homo sapiens
ccccgggctgcagaattcggcacgagatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83839 - DNA, 1023 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacagtggtggaacatctttaccaccaacgttttacctctgcttcaacaatttggccttgtcaaagacacctgctcatatgtaaatgtggtaggttctgtttcttttc

SEQ ID NO: 83840 - DNA, 1166 bp, Homo sapiens
  misc_feature (1130)..(1130): n is a, c, g, or t
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagttgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgtagatgcggccggctcnttacaataactactattcactgactccacacactcc

SEQ ID NO: 83841 - DNA, 808 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagcgcatttaaagtgttggtgcagtgcccaagttgt

SEQ ID NO: 83842 - DNA, 505 bp, Homo sapiens
ttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgtatattgctgtatcttggttgtttaattaaattaaggaatttcaccata

SEQ ID NO: 83843 - DNA, 1936 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83844 - DNA, 2345 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgtaaaaaaaaaaaaaaaaaaaaaaaaaaaaaaaaaagggggggggaaaaccgggggggcgaagccccaaggtgtttggttacaagggggcccccatgaggaagctgctatgaatgaaaccaaggcaagcgggccgctgtgtaacaacacgtccggcaggcgggaaacagcacccgctggggaccctgtggaaaaggcaccccacatcccggtggggggaccacaacagggcacaagtaccttaacaaaatttagacgcctctaggccaaaatttaaaaattgaagggtaacagtggaacccaacacgctattgcgcggcaggcaaggaaaaatggtccacacggatatgcatctttggaacaattctctaagcccaggcaaccagtaaaaatgagagaagtcccaataatgt

SEQ ID NO: 83845 - DNA, 2146 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgtagccgaaaaaaaaaaaaacaaacacaaaaacacacttggctggggcgtcgggccccgaaaaagttttcaaaaccatcggtggggccgggcccaggttttgccctgggccagccggccagagaaccgggcggccagggtggtttcccaaaaaaagcggggggcaccggtttgacacccaggggtggggctcgccctcacggccaggcgaatg

SEQ ID NO: 83846 - DNA, 1967 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgtaagaattaaccctcagtatacggccagcgttc

SEQ ID NO: 83847 - DNA, 1986 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgtagtatgcggcagccctttttcctttttttacttacacttttttttttgttc

SEQ ID NO: 83848 - DNA, 1133 bp, Homo sapiens
gccatgctgcaacgactctcttaattttccaccgctacaggtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83849 - DNA, 1128 bp, Homo sapiens
  misc_feature (25)..(25): n is a, c, g, or t
  misc_feature (27)..(27): n is a, c, g, or t
ggtagctgagtgactctcttatatncnccgctcaggtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83850 - DNA, 1987 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtgctttcagacttggtctatacactggctttctcttgtggcttctgtagaaaggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83851 - DNA, 2396 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtgctttcagacttggtctatacactggctttctcttgtggcttctgtagaaaggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgtaaaaaaaaaaaaaaaaaaaaaaaaaaaaaaaaaagggggggggaaaaccgggggggcgaagccccaaggtgtttggttacaagggggcccccatgaggaagctgctatgaatgaaaccaaggcaagcgggccgctgtgtaacaacacgtccggcaggcgggaaacagcacccgctggggaccctgtggaaaaggcaccccacatcccggtggggggaccacaacagggcacaagtaccttaacaaaatttagacgcctctaggccaaaatttaaaaattgaagggtaacagtggaacccaacacgctattgcgcggcaggcaaggaaaaatggtccacacggatatgcatctttggaacaattctctaagcccaggcaaccagtaaaaatgagagaagtcccaataatgt

SEQ ID NO: 83852 - DNA, 1814 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggaaacaaataggcccagtttctgataaatgcatccatggttaccaggtatgtgaccctgctcagaagacctagaaagtaccaagtctgtagttgcaaggtggggaccaaggcatactgaacacattttttagcagctgggcaacaacagatatcagaaaacacctgccgtttatttataacctaagcagcatctctatatactcctacctcccggcatttaaagtgaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83853 - DNA, 1115 bp, Homo sapiens
agggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagttgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 83854 - DNA, 844 bp, Homo sapiens
ggagtgtactggtccatacacgtgcgctcggaggtgatgggaacaggaagcatgttctggtcttccatgtgcacacacatttggacacataaacgtgcatgcacaggtgtccaggccaggcgtgtaagcccccaggagtgcatgcgtgtgtttgcgtgcagtctacaaacatgttttcacaaagctcaaggagaagcaatcagtcatctccaaggaatcttagcaacagccatccccagaaaaggctcctgccagctggggcagcgatgagtcagcagaggcgtcgtgggggaggcgggaggcgaggcagcctcagccctggagcctgagccggcctctcccttctcctgggaaggcctccagacccggcctggccgccacgcctgggtcactgctttggcactgatgtccgagaacacattcctggaactggccagcacaggcggctggagggtttttccctcctcctctctctccctctcaccctcctgtccgggccccacacccgcccttttatttttccttcttgctgcaaaaccaaaacaccgtgttcacgagttcaggcgctgtagccaagtggcaggagctggcagagcaattgggaaacaggagctgcctggcccaagcaggccaggggatgaggacacctctggccagccacagagagggccctgctagggcttgctgagccctggttaagtactgcagggcaaaaatgtcatcgcctggggccccagggaaccggagttcaaggtggcagctcccagagaaatggcctgtgtctctctgccccagtagcagagcccgaggtcactagcagaggatggcggctggaaggtgacca

SEQ ID NO: 83855 - DNA, 760 bp, Homo sapiens
cataaaatagaatgtatttctgagactaaacactttgctatttagatgtgctgatttcctaatgaggtcatttttatattctacaaacccagaagattcagaaagactccttgctgcttatgaggcagtgtccagaatgcacagcacagtttctggaacatagcagaagcacagtaaacatttatcaagggaactaatgctctatttggcctgctcaagctagagccagctcctctgtgctctgtacttgtcaacagactttccagccatagaggcaaaccagagcagactgatggatttcacccaaagttgttaatccgttaacaattggctgtaaaagtatgcgtatggaaacaaatggggaaactaaaaaccagatttgcagttgcagtgtaaaaatataattgccatgcgttagcaaaaagaaaggcccctcacagattgcaaatgttattttaatacataaggaaattgtactggatttaatgaatttgctttgaccatcagcaaaatggcatttcagatttcaagcacaaaacttttttttgttattttttttctcattccatcatttgaaaaaaatgggctcctgacaaattgatcaggcagttgtgccacaaggtatgtgaccttgggtaattcacttaactctctgagtcttgatttcctcattggtaaaatgggtgtaaaaatctatatttgtcagatgattggatgagatgatgcatacaaaatatctagcagagtgcctggaacacag

SEQ ID NO: 83856 - DNA, 394 bp, Homo sapiens
ggaagaaccatgtactccataaagcctgtccccactcactgtgagatacctgctcctcataaagtagtggcatagcctcctaggttcgggggaatggctgctgcttgctccccttatagactgaagcaaacaggctctgacttcagactttttttaccaaagaagtaaggaaatgccaattaacgatgtatgatatacatttacaggaaataatttaacgagtctatactgtgtctctagcatcttctacttatatgaagtataacataaagaatttaaggctgggcatggtggctaatgcctgtaatcctagcactatgggaggctgaggtgggcaaattgcttgagctcaggagttcaagaccagcctgggcaacatggtgaaaccccatct

SEQ ID NO: 83857 - DNA, 160 bp, Homo sapiens
ttggtgtcactctagagccacatagcaagtggcttcaagaggtaattcttgatccttttgtagttcatgagcgtgatgattgggtgttcacatgcatgtgtgagctgtgccaccctcgaaccttgttaccatgtaggcacattaccgatctgacatgaag

SEQ ID NO: 83858 - DNA, 273 bp, Homo sapiens
tactgggattacaggcatgagccaccgcgcccagccctattggtatatttttttaaaatatttatccatgttgtagcatgtatcagtaattcatttctttttattactgagtagtgttccatcgtagggatataccacaatttgtttagctatttatctgttggtgaatatttgggttttttcttgtgttgggcagtcacaaataaagctgctatgaatatgttttcatttctcttggataaaactccaagactgggattgctgggtgtcttt

SEQ ID NO: 83859 - DNA, 969 bp, Homo sapiens
  misc_feature (685)..(685): n is a, c, g, or t
caaacccatcagacagcacccacctggccagctccatcctgtcccaggaaccactactattctcattatgtgtatgttacagactttgaagtggtcccacaactccaaaatataaaatatgctattgtcaatacaaaatattggaaagaaaaaaaaaaaaaaaaaaaaaaaaaaaaaaaaaaaaaaaaaaaaaaaaaaaaaaaaaaaaaaaaaaagggggggccccaatccccacggaggcgcgcagagctcatcgccgctccccgccaggttttctttaagaaggcaaagggggcgccccaaaaagaaggaggcgctaataataaaacgaacaagcaagccgcaggcgccgcgcgggtagtaaaaacaacaggcgcggcagcaggagggaagaaaaacgtcgcaacggtggacgaactctttatggaagaagaaagagaccctaactcctcgggggcggaggcagcaataatggtggaagaagcaaactacactacgaaacagaatatataaaacgccatgggaggaaaatatataataaatcttttgcgagagtttgtaatgatggggttaaaacacgaaagcgcataataaatgcatgaggcggacagaaaaaaaatgtgtgttctacagtagaggagatcaatatattctgatctagaaaaaacaatatctttttaatccncgcggcgggaggctcgtgtttctaaatacaaaaacaggagaacagcaataaaaaacacaaacagcacaccagaccgagagccgaaaaaacagcacagacgacaatacacaaatgcaagaccaagaattacaaggaagaagaaaacgacaatgactaacgatcaagtcagcaaaagacacaacacaacaagcaaacacgcaagacacttcaacagaaccacaaaagaaaccaaaacaacaaaaaaccaaggaccaacaacacacaacacacataactaacacaca

SEQ ID NO: 83860 - DNA, 688 bp, Homo sapiens
cgcctcagcctcccaaagtgctgggattacaggcgtgagccaccgctcctggcctattcttttcttttcagagacaaggtctcactctctcctctcgcccaggctggagtgcagtggtgtcatcatagctcattgcagcctcaaactcctgggctcaagcaatcctcccacctcagcctcctgagtagctgggatcacaggtgtgtgctacctcacccagctaatttctaatttttttttgtagagactggatctcactgttgccttgaactcctgggctcaagtgatcctcctgcctcagcctcccaaagtgctgggattccagaccagccattttttttccttaatcatgcattcctgttgctagtttcacatcagtcccctggtttaataagaaataaaatattttcttcacacttttgaaaagacctttcttctttcataccccttctccctccaaaagggacaaaaattctttaatttcataaggagggtaggtaagtaacttgaggatgtgaacctttggtgttcctcagctggaacgtttctctctccgttgatgttgtagctgggactgggcttcttgactttggaagagggatggtatcctggcacctcctgtgtctgggactgaaaggcctgtggtgtctcctttgctcctctccctgtccccccttaagctgtattt

SEQ ID NO: 83861 - DNA, 5871 bp, Homo sapiens
gcaccacagaccagtctgtcctggtgttggatgttaaaagtggagccacaaagaagccatcttatgtgggacaggcttgggtgtgagaccagagctgtgggtagcagcatgttgggtcaggatgaggggcagaggaaacactttccacctcttggatatggattttatcctgccctgattcaggagatccccatctattaagtaaggggaaagatgattttgttgtcttttgtttcagattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgtttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccacgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatacgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagccaccactcctggccaactgtagttgaactcaggtattggaagggcttccgttttgttcttttcccattttttttttttgacttctagatcctttgcattttcgtataaaatttgaagtcaacttctatcaacttcaggccaggcccgtggctcatgcctgtataatcccagcactttgggaggccgaggcgggcggatcgcttgaggtcaggagttcaagaccagcctggccggggtggtgaaaccccatctctactaaaaatgcggaagagttagccaggcgtggtggcaggcgcctgtagaatcccagctgctcgggaggctgaggcaggagaattgcttgagcctgggaggtggaggtttcagtgagctgggatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaattt

SEQ ID NO: 83862 - DNA, 1038 bp, Homo sapiens
ttaggctagtacgggcggggttaaatcggcagagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtggtcagggttctactcttcgcttgttgtggaggggcctttcagtaatactgatcttggttagaaagtcggtctgaaggggtgcccagtttggggctccccttgggcgggtggtatttcgtgtcaaggggactcgccgggcgggggctatttgcggggggacccaaaaatttggggtgttgttctccgtttg

SEQ ID NO: 83863 - DNA, 5878 bp, Homo sapiens
gaccctttcaacatctcatttctcagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgtttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccacgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatacgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagcctaatttatcaaagatttgggtgtggtggctcatgtctgtaatcccagcactttgggaggccaaggtaggcagatcacctgaggccagaagtttgagaccagcctggccaacgtggtgaaaccccgtctctactaaaaatacaaaaattatctgggcgggtggcacacccctgtagtccctgctactcgggaggctgaggcaggagaatcacttgaacccaggaggcagaggttgcagtaaaccaagataataataataatgatttatgatattttataataatttgagtttaagaaatttgcctactcaaaggacatgattttttcctatgttttttatttttatggaacttttatagttttaccttttacatttaagtctgtgatccattttgagttcatttttgtgtaccatatgtgataagggtcaagattcacttttttatctgtgtggttggttggttcggttctatttgttgagactctactttcccaatgaccaagtcttcacaggtttgtaaaaactgaagtgacatagaagtggtctgttctggacaccattcttcttgtgtgtataactttacaccaatatgacactatattgattactgtagttttatttgaggcagaaatctcattctgttgcccaggctggagcgtagtggcacaatcacagctaatgtaacctcgaacatccgggctcaagtgagcctctttccttagcctcccaagtagttgggactgtaggcatgcatcaccacatcttgctaatttttgtattttttgtggagatgggggtctcactatgttgaccaggctggtcttggaactcctggcctcaagggatcctcctgcctcagctcccaaagggattacaggtgtgagccaccactcctggccaactgtagttgaactcaggtattggaagggcttccgttttgttcttttcccattttttttttttgacttctagatcctttgcattttcgtataaaatttgaagtcaacttctatcaacttcaggccaggcccgtggctcatgcctgtataatcccagcactttgggaggccgaggcgggcggatcgcttgaggtcaggagttcaagaccagcctggccggggtggtgaaaccccatctctactaaaaatgcggaagagttagccaggcgtggtggcaggcgcctgtagaatcccagctgctcgggaggctgaggcaggagaattgcttgagcctgggaggtggaggtttcagtgagctgggatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaattt

SEQ ID NO: 83864 - DNA, 6397 bp, Homo sapiens
gacgggggcgggcaacgccttagccgcagccccggctggctccggagcccggccgccttgccagggcacagtccgccgagagggccgggcggggtccgcaggccgctgtccccccgctagggcgtccaggagcggggccttggctagtcagtctcccggacgcagccacggccgcccccgcgaggctgcggcgtctctccagcgagccgcctcgggcccgagcctggggtcttgtccctgaggagcgccgtattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgtttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccacgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatacgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagcctaatttatcaaagatttgggtgtggtggctcatgtctgtaatcccagcactttgggaggccaaggtaggcagatcacctgaggccagaagtttgagaccagcctggccaacgtggtgaaaccccgtctctactaaaaatacaaaaattatctgggcgggtggcacacccctgtagtccctgctactcgggaggctgaggcaggagaatcacttgaacccaggaggcagaggttgcagtaaaccaagataataataataatgatttatgatattttataataatttgagtttaagaaatttgcctactcaaaggacatgattttttcctatgttttttatttttatggaacttttatagttttaccttttacatttaagtctgtgatccattttgagttcatttttgtgtaccatatgtgataagggtcaagattcacttttttatctgtgtggttggttggttcggttctatttgttgagactctactttcccaatgaccaagtcttcacaggtttgtaaaaactgaagtgacatagaagtggtctgttctggacaccattcttcttgtgtgtataactttacaccaatatgacactatattgattactgtagttttatttgaggcagaaatctcattctgttgcccaggctggagcgtagtggcacaatcacagctaatgtaacctcgaacatccgggctcaagtgagcctctttccttagcctcccaagtagttgggactgtaggcatgcatcaccacatctctactaaaaatgcggaagagttagccaggcgtggtggcaggcgcctgtagaatcccagctgctcgggaggctgaggcaggagaattgcttgagcctgggaggtggaggtttcagtgagctgggatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaattt

SEQ ID NO: 83865 - DNA, 4540 bp, Homo sapiens
tcaacctcagaactgctacaacagaagagttacgtagcgcattgagactgtgcctttcgagtgagacagaaagatacagaccagtaagtaaagaccttctcttgagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgtttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccacgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatacgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagcctaatttatcaaagatttgggtgtggtggctcatgtctgtaatcccagcactttgggaggccaaggtaggcagatcacctgaggccagaagtttgagaccagcctggccaacgtggtgaaaccccgtctctactaaaaatacaaaaattatctgggcgggtggcacacccctgtagtccctgctactcgggaggctgaggcaggagaatcacttgaacccaggaggcagaggttgcagtaaaccaagataataataataatgatttatgatattttataataatttgagtttaagaaatttgcctactcaaaggacatgattttttcctatgttttttatttttatggaacttttatagttttaccttttacatttaagtctgtgatccattttgagttcatttttgtgtaccatatgtgataagggtcaagattcacttttttatctgtgtggttggttggttcggttctatttgttgagactctactttcccaatgaccaagtcttcacaggtttgtaaaaactgaagtgacatagaagtggtctgttctggacaccattcttcttgtgtgtataactttacaccaatatgacactatattgattactgtagttttatttgaggcagaaatctcattctgttgcccaggctggagcgtagtggcacaatcacagctaatgtaacctcgaacatccgggctcaagtgagcctctttccttagcctcccaagtagttgggactgtaggcatgcatcaccacatcttgctaatttttgtattttttgtggagatgggggtctcactatgttgaccaggctggtcttggaactcctggcctcaagggatcctcctgcctcagctcccaaagggattacaggtgtgagccaccactcctggccaactgtagttgaactcaggtattggaagggcttccgttttgttcttttcccattttttttttttgacttctagatcctttgcattttcgtataaaatttgaagtcaacttctatcaacttcaggccaggcccgtggctcatgcctgtataatcccagcactttgggaggccgaggcgggcggatcgcttgaggtcaggagttcaagaccagcctggccggggtggtgaaaccccatctctactaaaaatgcggaagagttagccaggcgtggtggcaggcgcctgtagaatcccagctgctcgggaggctgaggcaggagaattgcttgagcctgggaggtggaggtttcagtgagctgggatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaattt

SEQ ID NO: 83866 - DNA, 6770 bp, Homo sapiens
gacgggggcgggcaacgccttagccgcagccccggctggctccggagcccggccgccttgccagggcacagtccgccgagagggccgggcggggtccgcaggccgctgtccccccgctagggcgtccaggagcggggccttggctagtcagtctcccggacgcagccacggccgcccccgcgaggctgcggcgtctctccagcgagccgcctcgggcccgagcctggggtcttgtccctgaggagcgccgtattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgtttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccacgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatacgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagcctaatttatcaaagatttgggtgtggtggctcatgtctgtaatcccagcactttgggaggccaaggtaggcagatcacctgaggccagaagtttgagaccagcctggccaacgtggtgaaaccccgtctctactaaaaatacaaaaattatctgggcgggtggcacacccctgtagtccctgctactcgggaggctgaggcaggagaatcacttgaacccaggaggcagaggttgcagtaaaccaagataataataataatgatttatgatattttataataatttgagtttaagaaatttgcctactcaaaggacatgattttttcctatgttttttatttttatggaacttttatagttttaccttttacatttaagtctgtgatccattttgagttcatttttgtgtaccatatgtgataagggtcaagattcacttttttatctgtgtggttggttggttcggttctatttgttgagactctactttcccaatgaccaagtcttcacaggtttgtaaaaactgaagtgacatagaagtggtctgttctggacaccattcttcttgtgtgtataactttacaccaatatgacactatattgattactgtagttttatttgaggcagaaatctcattctgttgcccaggctggagcgtagtggcacaatcacagctaatgtaacctcgaacatccgggctcaagtgagcctctttccttagcctcccaagtagttgggactgtaggcatgcatcaccacatcttgctaatttttgtattttttgtggagatgggggtctcactatgttgaccaggctggtcttggaactcctggcctcaagggatcctcctgcctcagctcccaaagggattacaggtgtgagccaccactcctggccaactgtagttgaactcaggtattggaagggcttccgttttgttcttttcccattttttttttttgacttctagatcctttgcattttcgtataaaatttgaagtcaacttctatcaacttcaggccaggcccgtggctcatgcctgtataatcccagcactttgggaggccgaggcgggcggatcgcttgaggtcaggagttcaagaccagcctggccggggtggtgaaaccccatctctactaaaaatgcggaagagttagccaggcgtggtggcaggcgcctgtagaatcccagctgctcgggaggctgaggcaggagaattgcttgagcctgggaggtggaggtttcagtgagctgggatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaattt

SEQ ID NO: 83867 - DNA, 5951 bp, Homo sapiens
ccaatatgtgatgatcgcggaacctgccgtcaaattgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgtttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccacgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatacgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagcctaatttatcaaagatttgggtgtggtggctcatgtctgtaatcccagcactttgggaggccaaggtaggcagatcacctgaggccagaagtttgagaccagcctggccaacgtggtgaaaccccgtctctactaaaaatacaaaaattatctgggcgggtggcacacccctgtagtccctgctactcgggaggctgaggcaggagaatcacttgaacccaggaggcagaggttgcagtaaaccaagataataataataatgatttatgatattttataataatttgagtttaagaaatttgcctactcaaaggacatgattttttcctatgttttttatttttatggaacttttatagttttaccttttacatttaagtctgtgatccattttgagttcatttttgtgtaccatatgtgataagggtcaagattcacttttttatctgtgtggttggttggttcggttctatttgttgagactctactttcccaatgaccaagtcttcacaggtttgtaaaaactgaagtgacatagaagtggtctgttctggacaccattcttcttgtgtgtataactttacaccaatatgacactatattgattactgtagttttatttgaggcagaaatctcattctgttgcccaggctggagcgtagtggcacaatcacagctaatgtaacctcgaacatccgggctcaagtgagcctctttccttagcctcccaagtagttgggactgtaggcatgcatcaccacatcttgctaatttttgtattttttgtggagatgggggtctcactatgttgaccaggctggtcttggaactcctggcctcaagggatcctcctgcctcagctcccaaagggattacaggtgtgagccaccactcctggccaactgtagttgaactcaggtattggaagggcttccgttttgttcttttcccattttttttttttgacttctagatcctttgcattttcgtataaaatttgaagtcaacttctatcaacttcaggccaggcccgtggctcatgcctgtataatcccagcactttgggaggccgaggcgggcggatcgcttgaggtcaggagttcaagaccagcctggccggggtggtgaaaccccatctctactaaaaatgcggaagagttagccaggcgtggtggcaggcgcctgtagaatcccagctgctcgggaggctgaggcaggagaattgcttgagcctgggaggtggaggtttcagtgagctgggatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaattt

SEQ ID NO: 83868 - DNA, 445 bp, Homo sapiens
gtgtctgccatatctttgcatccttcaatgacacttttgtccatgtcacggatctttctggcaaacaaaccatctgccgtgtgactggtgggatgaaggtgaaggcagaccgagatgaatcctcgccatatgctgctatgttgaccacccaggatgtggcccagaggtgcaaggagctgggtatcattgccctacacatccaactccgggccacaggaggaaataggaccaagacccttggacctgggcccagtcggccctcagagcccttgcctgctcgggtatgaagatcgggaggattgaggacgtcacccccatcccctctgacagcactctcaggaagggggtcaccgtggtcgccgtctgtgaacaagattcctcaaaatattttctgttaataaattgccttcatgtaaaaaataaataaaaaaagtgaaacctgtaa

SEQ ID NO: 83869 - DNA, 341 bp, Homo sapiens
gcttcagcctcctgagtagctaggactataggtgtaccactatgcccagctaattaaaaaaaattgtttttagagatgggggtcttgctatcttgcccaggttggtctggaacacctggcctcaaattatccttctgcttcggcctcccaaagcactgggatgacaggtatgaaccactgtgctcagcctattttcttcctttagttgagccatgttgccttgtttttcgttttttttttttaagtgtgctttgttatttttttagtgatttctgcatttgaaaaacaacaacaacaacaacaacaacaaaggagttctcccagtctttacagagtagttt

SEQ ID NO: 83870 - DNA, 759 bp, Homo sapiens
ggcccacccttttccgcccccttgaggcatggcacacagaccagtgcgcccactgcccgagcatggccccagtgggatgtggtggccacgaggggctgtacacacagcaggaggctgtccgccctgctcagggcctgctgcctatgccccagctgtccaaccaagggaggcatggaagggcccctggtgtaagctggagccaggcacccaggcccccggccaccctgcagagccaaggaaaggaagacacccaagtcaacaaggggcagggctgagggctgtcccaggctcttttggcccgaggggctgccagcagccctgacccggcatgggccttccccaaaagcgaccctgtgaggtggcctcacagagaaccccctctgaggacagtgtctgaccctgcctgcctcacacagatgggccccacagcagtgggcaacctggggggcagcagcccaacctgaccctgcagggactgccccctgcagcagcagctgcttctcagtcccccaacctccctgtccccgccagagggtcttccccgaagctgcagccccaacccatggctgcccacctggaaccgggactccctgtccactgccccctccccttcggggccccatctgtgctggggcccaggttcggcctacagattcccatcattgccatggcctcctgaccttgcctatccacccccaaccaccggctccatgctgaccctcccccaggctcccacgcccagctggccggccatcccca

SEQ ID NO: 83871 - DNA, 297 bp, Homo sapiens
  misc_feature (241)..(242): n is a, c, g, or t
gctggagtgcagtggtacaatctcggctcattgcaacctccacctcccaggttcaagcaattctcctgcctcaggctcctgagtagttgggattacaggcacccaccaccacacccagctaatttttgtatttttagtagagacagggtttcaccatgttggccaggctggtctcgaactcctgacctcaggtgagccacccaccttggcctctcaaagtgctgggaatacaggcgtggcnntcgtgcctggtctaaaaaatgtctattagtgttccatcactagatctcttctgag

SEQ ID NO: 83872 - DNA, 408 bp, Homo sapiens
ttcctccagacaggtgatcaggtctggcttagagacagcaatatactcaggaagaccaggtttctgtagttccctaacatcacattcctatataaattctgctgtgcagtgtccaggcattgccattcctccagagataattctatggccacctccctaaatgtcaatgatctcatttctaggcttccagggggtcctgggcatcttagcagtggatctcccaatacctgcaggtcacagggccacagaggctgggcctcttaggaagcagaagaaacagagaagtaaacacaagactgggagctctggctgcagtgagagacaaaggcctgtgtttgtctttttgacagtttgattataatatgtctcaatgtggctatctttgagttcatcatacttggagtttgt

SEQ ID NO: 83873 - DNA, 4235 bp, Homo sapiens
gcgctctcaggcgggctccggcggcagcgacgcgagcgcggcgatggggagcggcggcgtggtccactgtaggtgtgccaagtgtttctgttatcctacaaagcgaagaataaggaggaggccccgaaacctgaccatcttgagtctccccgaagatgtgctctttcacatcctgaaatggctttctgtagaggacatcctggccgtccgagctgtacactcccagctgaaggacctggtggacaaccacgccagtgtgtgggcatgtgccagcttccaggagctgtggccgtctccagggaacctgaagctctttgaaagggctgctgaaaaggggaatttcgaagctgctgtgaagctgggcatagcctacctctacaatgaaggcctgtctgtgtctgatgaggcccgcgcagaagtgaatggcctgaaggcctctcgcttcttcagtctcgctgagcggctgaatgtgggtgccgcacctttcatctggctcttcatccgccctccgtggtcggtgagcggaagctgctgcaaggccgtggttcacgagagcctcagggcagagtgccagctgcagaggactcacaaagcatccatattgcactgcttgggcagagtgctgagtctgttcgaggatgaggagaagcagcagcaggcccatgacctgtttgaggaggctgctcatcagggatgtctgaccagctcctacctcctctgggaaagcgacaggaggacagatgtgtcagatcctgggcgatgcctccacagcttccgaaaactcagggactacgctgccaaaggctgctgggaagcgcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtttatcagtaaagagatcctgaccatccgggaggccgtatggctcacggacaacacttacaagtacgaggacctggtgagaatgatgggcgagatcgtctccgccttggaagggaagattcgagtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagacacagccctggaccactcagctgtgggacctcaccggattctcctatgaagacctcattccctgcgtcttgagcctccataagaagtgcttccatgatgacgcccccaaggactacaggcaagtctctctgaccgccgtgaagcagcggtttgaggacaagcgctatggagaaatcagccaggaagaggtgctgagctacagccagttgtgtgctgcattaggagtgacacaagacagccccgaccccccgactttcctcagcacaggggagatccacgccttcctcagctctccctcggggcggagaaccaaacggaagcgggagaacagcctccaggaagacagaggcagcttcgttaccacccccactgcggagctgtccagccaggaggagacgctgctgggcagcttcctcgactggagcctggactgctgctctggctatgaaggcgaccaggagagtgagggcgagaaggagggcgacgtgacagctcccagcggcatcctcgatgtcaccgtggtctacctgaacccagaacagcattgctgccaggaatccagtgatgaggaggcttgtccagaggacaagggaccccaggacccacaggcactggcgctggacacccagatccctgcaacccctggacccaaacccctggtccgcaccagccgggagccagggaaggacgtcacgacctcagggtactcctccgtcagcaccgcaagtcccacaagctccgtggacggtggcttgggggccctgccccaacctacctcagtgctgtccctggacagtgactcgcacacacagccctgccaccatcaggccaggaagtcatgtttacagtgtcgtcccccaagtcccccggagagcagtgttccccagcaacaggtgaagcggataaacctatgcatacacagtgaggaggaggacatgaacctgggccttgtgaggctgtaagtgtgtcagcacatttgccgcagtggatgtgtactgagggggctggaggcgaagggtgggagcatagcataggaacgctgcatagaccatggaggcctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggttggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtcctgtcgactgtgtgcccctgggcatgtgtgagcctcagtttcctcatctgtaaggggggcaatgatacctacctcacaggggtgttgtgaggattaaatgtgaggaggatagtg

SEQ ID NO: 83874 - DNA, 814 bp, Homo sapiens
ctacacttttttttttttgtgatttaacgggcttttattcacacagttgtgcttgtcatcacaacaatcaaattgatgacattttcactttccccaaagggacaacacacccctcagctgtcaccctcccgttccccccaacttcctcagcgctagatgacccccagtagtctactttctgtccatggatgtttcccattctgtacattccatataaatggcgtcatcggacaagtggccttctgtgtctaggtgatttccctcgcggtaacgtttgctgggtttgtccatgtggtgtgtgtccctgctttgttctttttcatggctgaataatattcccctgcatggaccacatgtgtttatccatcccgcagctggtggacattttgcctattgtgaacagtcctgccatgaacattctagtacaggtttctgtgtggacatagtttttcctttttcctgggtctttacctagagaggaattgctaggtcctgtggtgactgagtttaaccattcggggaactgcccaggtcagattccagagtgactgcaccattttgcattctcattgctcacttcagtgaactgaagctaaaaatggggtgggggtgcctcacatgtccactccacgtgactctgtttccagcttccatgatgacgcccccaaggactacaggcaagtctctctgaccgccgtgaagcagcggtttgaggacaagcgctatggagaaatcagccaggaagaggtgcctccctcccgccacctgggcgtctcatggggtgctggggtgtgggcgggcctcaccctctggc

SEQ ID NO: 83875 - DNA, 3352 bp, Homo sapiens
ctacacttttttttttttgtgatttaacgggcttttattcacacagttgtgcttgtcatcacaacaatcaaattgatgacattttcactttccccaaagggacaacacacccctcagctgtcaccctcccgttccccccaacttcctcagcgctagatgacccccagtagtctactttctgtccatggatgtttcccattctgtacattccatataaatggcgtcatcggacaagtggccttctgtgtctaggtgatttccctcgcggtaacgtttgctgggtttgtccatgtggtgtgtgtccctgctttgttctttttcatggctgaataatattcccctgcatggaccacatgtgtttatccatcccgcagctggtggacattttgcctattgtgaacagtcctgccatgaacattctagtacaggtttctgtgtggacatagtttttcctttttcctgggtctttacctagagaggaattgctaggtcctgtggtgactgagtttaaccattcggggaactgcccaggtcagattccagagtgactgcaccattttgcattctcattgctcacttcagtgaactgaagctaaaaatggggtgggggtgcctcacatgtccactccacgtgactctgtttccagcttccatgatgacgcccccaaggactacaggcaagtctctctgaccgccgtgaagcagcggtttgaggacaagcgctatggagaaatcagccaggaagaggtgctgagctacagccagttgtgtgctgcattaggagtgacacaagacagccccgaccccccgactttcctcagcacaggggagatccacgccttcctcagctctccctcggggcggagaaccaaacggaagcgggagaacagcctccaggaagacagaggcagcttcgttaccacccccactgcggagctgtccagccaggaggagacgctgctgggcagcttcctcgactggagcctggactgctgctctggctatgaaggcgaccaggagagtgagggcgagaaggagggcgacgtgacagctcccagcggcatcctcgatgtcaccgtggtctacctgaacccagaacagcattgctgccaggaatccagtgatgaggaggcttgtccagaggacaagggaccccaggacccacaggcactggcgctggacacccagatccctgcaacccctggacccaaacccctggtccgcaccagccgggagccagggaaggacgtcacgacctcagggtactcctccgtcagcaccgcaagtcccacaagctccgtggacggtggcttgggggccctgccccaacctacctcagtgctgtccctggacagtgactcgcacacacagccctgccaccatcaggccaggaagtcatgtttacagtgtcgtcccccaagtcccccggagagcagtgttccccagcaacaggtgaagcggataaacctatgcatacacagtgaggaggaggacatgaacctgggccttgtgaggctgtaagtgtgtcagcacatttgccgcagtggatgtgtactgagggggctggaggcgaagggtgggagcatagcataggaacgctgcatagaccatggaggcctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggttggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtcctgtcgactgtgtgcccctgggcatgtgtgagcctcagtttcctcatctgtaaggggggcaatgatacctacctcacaggggtgttgtgaggattaaatgtgaggaggatagtg

SEQ ID NO: 83876 - DNA, 4449 bp, Homo sapiens
gcgctctcaggcgggctccggcggcagcgacgcgagcgcggcgatggggagcggcggcgtggtccactgtaggtgtgccaagtgtttctgttatcctacaaagcgaagaataaggaggaggccccgaaacctgaccatcttgagtctccccgaagatgtgctctttcacatcctgaaatggctttctgtagaggacatcctggccgtccgagctgtacactcccagctgaaggacctggtggacaaccacgccagtgtgtgggcatgtgccagcttccaggagctgtggccgtctccagggaacctgaagctctttgaaagggctgctgaaaaggggaatttcgaagctgctgtgaagctgggcatagcctacctctacaatgaaggcctgtctgtgtctgatgaggcccgcgcagaagtgaatggcctgaaggcctctcgcttcttcagtctcgctgagcggctgaatgtgggtgccgcacctttcatctggctcttcatccgccctccgtggtcggtgagcggaagctgctgcaaggccgtggttcacgagagcctcagggcagagtgccagctgcagaggactcacaaagcatccatattgcactgcttgggcagagtgctgagtctgttcgaggatgaggagaagcagcagcaggcccatgacctgtttgaggaggctgctcatcagggatgtctgaccagctcctacctcctctgggaaagcgacaggaggacagatgtgtcagatcctgggcgatgcctccacagcttccgaaaactcagggactacgctgccaaaggctgctgggaagcgcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtttatcagtaaagagatcctgaccatccgggaggccgtatggctcacggacaacacttacaagtacgaggacctggtgagaatgatgggcgagatcgtctccgccttggaagggaagattcgagtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagacacagccctggaccactcagctgtgggacctcaccggattctcctatgaagacctcattccctgcgtcttgagcctccataagaagtgcttccatgatgacgcccccaaggactacaggcaagtctctctgaccgccgtgaagcagcggtttgaggacaagcgctatggagaaatcagccaggaagaggtgctgagctacagccagttgtgtgctgcattaggagtgacacaagacagccccgaccccccgactttcctcagcacaggggagatccacgccttcctcagctctccctcggggcggagaaccaaacggaagcgggagaacagcctccaggaagacagaggcagcttcgttaccacccccactgcggagctgtccagccaggaggagacgctgctgggcagcttcctcgactggagcctggactgctgctctggctatgaaggcgaccaggagagtgagggcgagaaggagggcgacgtgacagctcccagcggcatcctcgatgtcaccgtggtctacctgaacccagaacagcattgctgccaggaatccagtgatgaggaggcttgtccagaggacaagggaccccaggacccacaggcactggcgctggacacccagatccctgcaacccctggacccaaacccctggtccgcaccagccgggagccagggaaggacgtcacgacctcagggtactcctccgtcagcaccgcaagtcccacaagctccgtggacggtggcttgggggccctgccccaacctacctcagtgctgtccctggacagtgactcgcacacacagccctgccaccatcaggccaggaagtcatgtttacagtgtcgtcccccaagtcccccggagagcagtgttccccagcaacaggtgaagcggataaacctatgcatacacagtgaggaggaggacatgaacctgggccttgtgaggctgtaagtgtgtcagcacatttgccgcagtggatgtgtactgagggggctggaggcgaagggtgggagcatagcataggaacgctgcatagaccatggaggcctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggttggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtcctgtcgactgtgtgcccctgggcatgtgtgagcctcagtttcctcatctgtaaggggggcaatgatacctacctcacaggggtgttgtgaggattaaatgtgaggaggatagtgaaaaaaaaaaaaaaaaaaaaaaaccccggagggccccataggccggggggcgggaaaacaggggcgtacctgacagggcgccatgggcccaatacgcggtccctggacccagcttccctggtcccaggggggaaacacccggcgggggcccccaataaggagaggcggaataaacttccgaaaaaccgcaggttaccgtgtagagccccccgca

SEQ ID NO: 83877 - DNA, 405 bp, Homo sapiens
ttaatttttatttttgaccacttatccaagttctatgtagcactgttttttttgagatggagtctcgctctgtcgcctgtgctggagtgcagtggtgtgatcttggctcactgcaacctccggctcctgggttcaagcaattctcctgcctcagcctcctgagtagctgggattacaggaacctgccaccactcccagctaatttttgtatttttagtagagatggggtttcaccatgtttgccaggctggtctcgaactcctgacctcaggtgatccacctgcctcggcctcctgaagtgctgggattgcaagctatgcagcactgtttttatagcaaaacattggactaactaaacgtctatccacaagagacaagttggttagtaaatggctgtaattctat

SEQ ID NO: 83878 - DNA, 888 bp, Homo sapiens
ctcttggtttccgctatcgggtaagaggtggtaattttgaggtcatattaggtggcctgtctgaaaatggctggaaacccgagtacactttttcttctaactatgtcaagctcttggggtttgtcttaagaagtcccatcccttcgaggcttttgccgtctcaactcttgttgcctgattagtcctagaaaagctcagtcccaagagggcctacctcgtatcacagattcacaggtctgtgactggaagcctccacaaatttgtgggttactggaggcaaacatcatccttaaccatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaaggcacatactagtgtgatagctacccttaaaaattctcttgacaatattatctgtcttgtgtagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccattta

SEQ ID NO: 83879 - DNA, 419 bp, Homo sapiens
ttcagacatctctagcagcgaacactttgaccattaccagacatgctgagacaaagcagctaacagaaatgccacccagtgtcttaaaccagcttggtgtcaacaagcttaaggaaactggcagaagctggatggaaaagtaccacttactattggggaagtggtgatcttgttcagaattttgatgaagcttccaacagtgaggcaaactgaattgattcagcttctaaaaaataatacaatttcaagaattttaactgcttttaaaatttttgttttatatatgataaaatgtaagtctataaattccaagacccttggacactgctttttaattattgattatatacagttatttattggcaattaattagccagaaaatagtttaaaacaaagataaagcctttgcctagttaaa

SEQ ID NO: 83880 - DNA, 193 bp, Homo sapiens
gctataaactgaactaccacagagtctcaatgaagccaaattaacgaaactttatgtatattatccccaaatgcggtgagggagtatttaaatgtaagacattcaaaatattgcccattttagtaacattcttcaaagaccattggtttgacactgaaggagaaaaaaattgaaaaagtcatgattttacttt

SEQ ID NO: 83881 - DNA, 400 bp, Homo sapiens
catttatattcttgagaaaacatataccatacatagattttaaaaaggattttatcagaatatttaaataatttctaaaactcagtaatagcttttgtgtttaaacctatggtctttttcaaattatgtttgagtattgtgagagatgtatttgaagttgttttttcccctcatatggatatccagttgtttcaataccttttgttgaaatgactttccttttggtgtctttgtaaaaagtgactatataattgtgtgtctatttctggactcttaattctattccactgacctatttgtctatccttatgcaacattactgtgtcttggatactataacttttagaataagttttgacatcaggtaatgtgaatactccaattttgttcttatttttca

SEQ ID NO: 83882 - DNA, 460 bp, Homo sapiens
ccttcacttatgaagctaagtttggctggatatgaaattctggattgaaaattcttttctttaagaatgttgaatatcggcccccactctcttctggcttgtagagtttctgccaagagatccgctgttagtctgatgggcttccctttgtgggtaacccgacctttctctctggctgcccttaaaaatgttattttcaaaatgttcaaaagtttatttaatttttagcctttcaattttgtgaacaaagaggctgttcttgaagtttaggctctgtgttggcttgatgaaaggatatcactatttaaaagggctgaaagtttgcctgtacatactgttgagattttctgcatgaaacacaagaatgtaaaataactatagattaaactagatagaatcttaaatttcttgcatgttcaggtactcaagttccttgcaatcaccacctggccatctttag

SEQ ID NO: 83883 - DNA, 573 bp, Homo sapiens
cattgagcatcttcagggtgttactctttccttattttactatccaagagctccagaatccctttattccccatcccaaggccacttaaaaaattactaagtgaacaattactaaaaattgctactagaatgaatatatttaaaaatatgcttaaatttcagtattgtcctatacaaaaccatttctcttcgtaggaagagaactatttcattgggctacattgagcatcttcagggtgttactctttccttattttactatccaagagctccagaatccctttattccccatcccaaggccacttaaaaaattactaagtgaacaattactaaaaattgctactagaatgaatatatttaaaaatatgcttaaatttcagtattgtcctatacaaaaccatttctcttcgtaggaagagaactatttcaagaacctcactatttcaagaaccttattttgccattacttctttgttagcatcttcacatgcacagtgagtctggaaagatttccagcctcttttcttccattttgaattctcagagggcaatattttgcttgattttaaaag

SEQ ID NO: 83884 - DNA, 787 bp, Homo sapiens
caaaccctaaggcttctgaggatagcacttgactggagacaaggtcaccttggccagcaggattgcaacaaaggaagaatgaggttgaaacctcagaattggtcgtcagaattgtatttcaccacagtctccacacagggtcagacttttccagtgagaaagtctgcctttgtcccttgtcttatggtgtaatgtgtacccttggcccacttctcacagtaaatgctagccttggatgagctcatcctttcccggggcttcagtcagcatgtcggtgcaaatgactcacaaaccctcaactccagtcctccggcagctactaagctccacagctgcacttgcagctgctcagtcactcctaggtggatattccacaggcactttacactcaacacatcctattctctcccaacttcttattccccaaactacttctcctttggtttctaatctcaataatcaataccaatatacttctagttactcagtcttgaaaccaccatcttcccccaaaatgtctctcaggtccacttttctgctccactgccctagttaaggccctattgcctggcttggattgtaatacatatctaatatctgtgtcccctttccacctcctccagctcatccttcaaactacctccaggtgtctgatagggttactcctagatcagaagtcctgacaggttccccactgcctaaagtggggactccataaaatggcattcaaggctttccacactcttatcccattcttaccatccgtatcctgttcttagcatcccca

SEQ ID NO: 83885 - DNA, 263 bp, Homo sapiens
gttcaagcaattctgtctcagcctcctgagtagctgggactacaggcacacgccaccacgtccagctaatttttgtatttttagtagagatggcatttcaccgcattggtcaggctggtctcaaactcctggcctcaggagatctactgccttggcctcccaaagtgttgggattacaggcgtgagccaccacgcccggcctattttattttattattaaagtattgttctttattttattagagacaagggtctcactgtgt

SEQ ID NO: 83886 - DNA, 2852 bp, Homo sapiens
  misc_feature (1639)..(1639): n is a, c, g, or t
gcgcgggaggcggtaccaacccctgccgcaggactttcctgggccggctcgcggagagcgtagcgcggccttggtggcggaatggcgttgagtgacggcccggccccgccatctggttaaagggactcgttcaacacggaagtgtcccggggctgcattgtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgcaaaacacgttttagatagtttttgatggaagtttctaatcaaatcctttttagaaaatctatcatgactcaattgtattactccttgtaatatttgtgtttatttttaatatttgaattattacttagcacatggatataagaggcactttattagaatttgacaacgtcattaagaaggatacacttaggtgataaggaatcatttttggtgaactgttgtgtcctttaaaaaatggaggaggataggttctttgggtaaattgaggaacatggaaaatggagggccaccacttaggttccatggagaatatgtggcatgatcttgacgtgaagcatgggtgtttccgtgacttagctgtgtccctgtagctctggaactgaaggaactaggtaggagaggaaggatttgagaaataggcaactcatggttaaagacctttgatcaggactggaggaacaaaggtttgtgtattagtccattttcacactgctgagaaagacatacccaagactgggcaatttacaaaagaaaggtttaatgggctcacagttccacatgactgaggaggcctcacaattgtggtggaaggtgaaaggcatgtctcacatggcagcagacaagagaagaaaacttgtgcagggaaactcccctttataaaaccatcggatctcttgagacncgttcactatcatgagaatagcatgggaaagacctgcctccatgattcagttacctcccactgggtccctcccacaacgtgtggcaattgtgggagctacatacacttcaagatgagatttgggtggggacacagccaaaccataacagtttgctttccacaggtgtgtgcagttgctcccagtgcagttaggggcagatatccagaagcctaggagattttgaagaggcttatcccctctcatcttcctcccctaaaccccaccccagtttaggagattatcaagctggttgtcattcattctctctctctctctctctctctctctctctctctctctctctctctcgccatacctctctgagtatttagctattgttctatatactggatacatctattatgggaacttaaatagataaaatactactaaacacaaagaaccaagtagcctagtaaataagaattaaatccagaataatcattcacttctcatttttaaatcacgttgtactgatcccaggttttttactttctgagtagttgtccatcactttgaggacttgtgtatgggcttgtaccaatttactgacactgtcttaaatcctaaatctgtttttatgaggttttgccaagcaagaactcttgattactaagaggcagttagagacaaaccaatttaattccatgtcttcaattgtcacgcatttcttcttttactctttgaaactattctttgagtcaattttatggttctcagaagccaaaatacacaacttttagcacataaacaccaacgatggcctctttttgaggagttatgcatagacccactctagagtaatgatggtccctgtggtatatactttctcctactctagcaaacatgtagtttaatcttaatgtgttgtttccataagtgacatgaagtggatagattctcaattgttatgtccacttattcactaggtaaattttcagttttaatacttttctccttaccccttcctttgatcatttcatgtgaatattctatttgtatgatacactgtatttcaataaattccttgttgatgtacccttaaattgaagaaatttaagctgcaaaaccaaatctcattgtataagacttttttgaagtatcttgtatcgactacatatgtatttgaccctgtgggaggatggtacttttctttttaacttttattttaag

SEQ ID NO: 83887 - DNA, 2730 bp, Homo sapiens
  misc_feature (1517)..(1517): n is a, c, g, or t
gagggtaaggcacttccggggcacagaaaatgaggattattaaaggtcagttgctcgcagtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcgtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgcaaaacacgttttagatagtttttgatggaagtttctaatcaaatcctttttagaaaatctatcatgactcaattgtattactccttgtaatatttgtgtttatttttaatatttgaattattacttagcacatggatataagaggcactttattagaatttgacaacgtcattaagaaggatacacttaggtgataaggaatcatttttggtgaactgttgtgtcctttaaaaaatggaggaggataggttctttgggtaaattgaggaacatggaaaatggagggccaccacttaggttccatggagaatatgtggcatgatcttgacgtgaagcatgggtgtttccgtgacttagctgtgtccctgtagctctggaactgaaggaactaggtaggagaggaaggatttgagaaataggcaactcatggttaaagacctttgatcaggactggaggaacaaaggtttgtgtattagtccattttcacactgctgagaaagacatacccaagactgggcaatttacaaaagaaaggtttaatgggctcacagttccacatgactgaggaggcctcacaattgtggtggaaggtgaaaggcatgtctcacatggcagcagacaagagaagaaaacttgtgcagggaaactcccctttataaaaccatcggatctcttgagacncgttcactatcatgagaatagcatgggaaagacctgcctccatgattcagttacctcccactgggtccctcccacaacgtgtggcaattgtgggagctacatacacttcaagatgagatttgggtggggacacagccaaaccataacagtttgctttccacaggtgtgtgcagttgctcccagtgcagttaggggcagatatccagaagcctaggagattttgaagaggcttatcccctctcatcttcctcccctaaaccccaccccagtttaggagattatcaagctggttgtcattcattctctctctctctctctctctctctctctctctctctctctctctctcgccatacctctctgagtatttagctattgttctatatactggatacatctattatgggaacttaaatagataaaatactactaaacacaaagaaccaagtagcctagtaaataagaattaaatccagaataatcattcacttctcatttttaaatcacgttgtactgatcccaggttttttactttctgagtagttgtccatcactttgaggacttgtgtatgggcttgtaccaatttactgacactgtcttaaatcctaaatctgtttttatgaggttttgccaagcaagaactcttgattactaagaggcagttagagacaaaccaatttaattccatgtcttcaattgtcacgcatttcttcttttactctttgaaactattctttgagtcaattttatggttctcagaagccaaaatacacaacttttagcacataaacaccaacgatggcctctttttgaggagttatgcatagacccactctagagtaatgatggtccctgtggtatatactttctcctactctagcaaacatgtagtttaatcttaatgtgttgtttccataagtgacatgaagtggatagattctcaattgttatgtccacttattcactaggtaaattttcagttttaatacttttctccttaccccttcctttgatcatttcatgtgaatattctatttgtatgatacactgtatttcaataaattccttgttgatgtacccttaaattgaagaaatttaagctgcaaaaccaaatctcattgtataagacttttttgaagtatcttgtatcgactacatatgtatttgaccctgtgggaggatggtacttttctttttaacttttattttaag

SEQ ID NO: 83888 - DNA, 958 bp, Homo sapiens
gcgcgggaggcggtaccaacccctgccgcaggactttcctgggccggctcgcggagagcgtagcgcggccttggtggcggaatggcgttgagtgacggcccggccccgccatctggttaaagggactcgttcaacacggaagtgtcccggggctgcattgtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgca

SEQ ID NO: 83889 - DNA, 858 bp, Homo sapiens
gagggtaaggcacttccggggcacagaaaatgaggattattaaaggtcagttgctcgcagtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgca

SEQ ID NO: 83890 - DNA, 836 bp, Homo sapiens
gagggtaaggcacttccggggcacagaaaatgaggattattaaaggtcagttgctcgcagtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcgtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgca

SEQ ID NO: 83891 - DNA, 417 bp, Homo sapiens
agattgctttttcttctttagaagtgggatggagtcgattcttcctcccagcgctcacgagctggcccagaaccgactgcacgtatccatcaccaacgccaaaaccagagaaaatcacttagtctccactttttcctccagggaggacctcattaaggtaacaaagccatgtttcctatttgaagaaatcagcaagtgctgatttcaatacttcatataaagtaatgagcattaccacgttctttagatcctgtgtctcttaccaggcccgatagatggttgagtgctcagtaaattacttgtttgatgaaagtattcgccaggatccctcctgaggccgccttatgatgcactgtgatccaaatgctccctgtacttgttcagtgttttcctgcaatgttcagatctcacgttgat

SEQ ID NO: 83892 - DNA, 172 bp, Homo sapiens
gaagaatgcagcatgagagaggaaacagagccctgtggctttcctggactagattcaagtcctgctatcgtagtcacctcaggctgccataaaaaaatatcaaagactgggagccttaaacagcagatacttatttctcacagtgttggagtcttcaaagttcaagatcaag

SEQ ID NO: 83893 - DNA, 1440 bp, Homo sapiens
gaattccccccccccccccctcacttggtgtgtctatatgtctggcagacattatcagcacattctctgttgttacctgtgattcattttttcttcactctccaggtgaatttcaattgctgaaaatttcccactgaaaatatgcagtaatatattttgtggttcagacatttggggcaaatggttcacattcattttagggttagtggtcatgctgtttatttttctctgctatacaaagttcctcttaggggtctgcctcatgacactaaaaaatgaatagagattctactgtaggttatctcctaggcttgagttcaacatttgtttggatttttgaagaaagtcaaatcaagcaatgctcccaaatgatgtctttgtaaattcataccctctggccctattttttttcatagaccctaactctacctttctgctttaaagcaaagtaaactcggtggcctcttcttctccacccctcaaaatgatagcaatctctgccgtcagcagtgcactcctgttctcccttctctgtgaagcaagtaccgtcgtcctactcaattccactgactcatccccgccaaccaataatttcactgatattgaagcagctctgaaagcacaattagattcagcggatatccccaaagccaggcggaagcgctacatttcgcagaatgacatgatcgccattcttgattatcataatcaagttcggggcaaagtgttcccaccggcagcaaatatggaatatatggtttgggatgaaaatcttgcaaaatcggcagaggcttgggcggctacttgcatttgggaccatggaccttcttacttactgagatttttgggccaaaatctatctgtacgcactggaagatatcgctctattctccagttggtcaagccatggtatgatgaagtgaaagattatgcttttccatatccccaggattgcaaccccagatgtcctatgagatgttttggtcccatgtgcacacattatacgcagatggtttgggccacttccaatcggataggatgcgcaattcatacttgccaaaacatgaatgtttggggatctgtgtggcgacgtgcagtttacttggtatgcaactatgccccaaagggcaattggattggagaagcaccatataaagtaggggtaccatgttcatcttgtcctccaagttatgggggatcttgtactgacaatctgtgttttccaggagttacgtcaaactacctgtactggtttaaataagtttaccttttcctccaggaaatataatgatttctgggaacatgggcatgtatatatatatatggagagagaattttgcacatattatacatattttgtgctaatcttgttttcctcttagtattcctttgtataaattagtgtttgtctagcatgtttgtttaatcctttgggaattc

SEQ ID NO: 83894 - DNA, 1373 bp, Homo sapiens
gaattccccccccccccccctcacttggtgtgtctatatgtctggcagacattatcagcacattctctgttgttacctgtgattcattttttcttcactctccaggtgaatttcaattgctgaaaatttcccactgaaaatatgcagtaatatattttgtggttcagacatttggggcaaatggttcacattcattttagggttagtggtcatgctgtttatttttctctgctatacaaagttcctcttaggggtctgcctcatgacactaaaaaatgaatagagattctactgtaggttatctcctaggcttgagttcaacatttgtttggatttttgaagaaagtcaaatcaagcaatgctcccaaatgatgtctttgtaaattcataccctctggccctattttttttcatagaccctaactctacctttctgctttaaagcaaagtaaactcggtggcctcttcttctccacccctcaaaatgatagcaatctctgccgtcagcagtgcactcctgttctcccttctctgtgaagcaagtaccgtcgtcctactcaattccactgactcatccccgccaaccaataatttcactgatattgaagcagctctgaaagcacaattagattcagcggatatccccaaagccaggcggaagcgctacatttcgcagaatgacatgatcgccattcttgattatcataatcaagttcggggcaaagtgttcccaccggcagcaaatatggaatatatggtttgggatgaaaatcttgcaaaatcggcagaggcttgggcggctacttgcatttgggaccatggaccttcttacttactgagatttttgggccaaaatctatctgtacgcactggaagatatcgctctattctccagttggtcaagccatggtatgatgaagtgaaagattatgcttttccatatccccaggattgcaaccccagatgtcctatgagatgttttggtcccatgtgcacacattatacgcaggttatttcaattaccttgttaatttttgattcatacttttaaaatatgctaatactattttggtggacatgcattgtcttagctctgacttctgtaacagtttattggtttattttcacagatggtttgggccacttccaatcggataggatgcgcaattcatacttgccaaaacatgaatgtttggggatctgtgtggcgacgtgcagtttacttggtatgcaactatgccccaaagtaagtaccaggttggattctatttcctggatcctttaaagacgttaaatatccctaggctgatagttatctgtgacaggtaagtgagtaaggcttagctataatggcctctaatcctcaaatccac

SEQ ID NO: 83895 - DNA, 1953 bp, Homo sapiens
gattttagacaagtcaactcttctaaattggcttctcatctatgaaatggggataatagatctgcctaattaggttgatttgagataacggatgtaaaacacctaataaaataagcatccagcaaatgacttgttcactctctgaatacagacttctggtcatgtagttcggtcacactcctgatagcttctagaacatcagggttttaggagaaataggttaaaatgaacatcaagagtagcagaagactactttccttaatatttgagtgccagctatatgccacacagttctagttgctggcagtcagcagtaaacaaaaacttcacctgatgcagcacattccaggtgggggaacaagtgaaaatatagggaatattagtgataagtgcagagggaaaaaaaatagagcagggaagggggatgatttgatgtttttcaggttaagaaagtgacagaaatgaatttaaatgcaaaaaacaatgcataaagattcataatggcaaaacgaagcatgtcccatcataccccttcattcctacctccctgatatgtatctttctaattattcatacaaatgtgtatacccagttattacatatggggttttattctacatattatactgcacttgctttttctaatataatgtgtatcatgagcaccttacaaatttttaaaggtctctcaaatttatcagtaaacatatacagtctaacgttaatgagaagatattttggtgggcagtttgctttaaataaatgggatcatgtacgttctctgcatctcacatttctcatttaacaatgtaggatgagaatttctctaagtctatcatagctcttatttcctttttattattacaataaacattcctgtgtatatgtttgtcaccatgatggttttacgtctgcggaatagattccctggagtaggattgctgcattgaggagtatgtatatttaaatttttaaataaatattgacagattgtttccaaaagtggccggaacagtttttatttccatcagtaaatgtataaaaacacttttcccttaatactcatggcaataactattgtaacattaaaaaatacatagaaaaaagaaaaaaatcctggtggatgtagtgatttttcagtgttattttaatttccattttcctgactactataaatgtagacatcttttcaaatgttttggtcatctggattgcactcagaactgaattatctattcaaagttctgtaggttagaactccagggaaactcaactgggctgtctgttcaaggcccaacaaggctgaaatgaaagtgtcttccagggtgggtactcaactaaagctctgaggaggaattcgcttccagcctcattaaagtcagaggatggaggtccctgtctcctagctgactgtcaaatctgatcctttagaggttgctccgtggtccttgcacgtggtcccttccaccttcaaagcttgccagggtgcatcaaattatttttatactttgactctacttctaccagccagagaaaactgcttttaaagggctcttgtgactagtttaagcacacccagattgttaaggtcaactgattagtagctttaattacatctgccaagtccctctgccctgcaatgtaacatcacccatggaagtaacatgaggggcagagttcatgggggccatcttagaattctgcctaccacaaatattcgtagttatacttttatatacatttttaaatttttcttatttttggtccatatgtttgtaccgtttgtctttttagttaactagtttgtgaaagcattttgtatgttgtacaatatatgttcagattttcttatcttggatgcaaacatttttttccaactcttgtaagttgtctgttgaccacattcaaaagtactttttccaaataaaactttgccttttgaatttcacttga

SEQ ID NO: 83896 - DNA, 330 bp, Homo sapiens
ggtagatatagggtctgcctccctgtgtctcccaggctggtctcaaactccaccctcctcagcctcccaaagtggtgcgattacaggcgtgagccatggctcccaggcctaaatgaaatcatttacaataacatcaggaaacattaaatacctaggagtaaattaaaaatgtacaagtcttctacacagaaaactgtacaatattaagacacagaatccataaagacctttaaaatgacaggatagctcatgttcattgataagaaagactcaaaaagaaatacatatggagtctttctgagcctgctctggctgaggaggctgcccaat

SEQ ID NO: 83897 - DNA, 344 bp, Homo sapiens
aattattagaactaataataatagttctgcaaagttgctgagtttcagatcagcaaccttttgattcaaccatacaaaattataatttatgtaggtcaaaatggtcgttaaatatttatttgcagtttcatatgattaaacctaatacagaaatcaatcacattcctgtctaccagcaataatcatttagtaaatgtatacttttttaaagattctattcatagtagccacaaaaaaactataaagtatccaggaaatatctaaacaagaaatatatatcttggggagaaaacataatcaaaagacctggataaacagagagatagcatgttcatggatgggag

SEQ ID NO: 83898 - DNA, 707 bp, Homo sapiens
ataacagaagaataactgtgtatttggatttacataggtagactttgtgagagtagatgttttaaaaaaatgactcaaattagtaccttttaactgttcagaaaaacaaaacctcaattttctggttttcctgcccattttctctgcttcttcacttggggcagagaaaaagcaagttgcagaatatgcactacatgctgctatttgtttgaaattttaaaagacaatataatactgcatacagataaaggatacatacacatctagtaagagtataaacatgcatgagaataataaacaccaaattcagggtaatagttgcctctggaaggggaggtatggaggggtcacagaggacttcagctttattggtaaaatttcataagttgggtagcaaggacacaaatgtatgttattcattgtacctttttgtatattttaaatatttcataatcaaattttttcctgagaatgaaaactcttttgtgactttcccaatgttagtggaaacaaataagatctgaagctgattccctttagaaactctcaacacttcttagctatgttcaccaaatgcgtgagcattgataaattagactttatcaaaaaaaaaaacttgtgcctcaaaggacaccatcaagaaagtaaaaagacagcccacagaatgggagaaaatatttggaaatattgaatctgataagagactt

SEQ ID NO: 83899 - DNA, 449 bp, Homo sapiens
aaacaaacaaaaaaaacctgctgagtggacatctgtaagaaagaagatgttccctcaattctcttctagctgacataatgaggatgataccactcctcccatgaatgggtcacatgtgttgagcatatgccaggtgccaggcatgattctaggtgtgtacgcagatggactcattttaatcatcacaacaatcctcttcaacaggtattaccaccattccagtttcacagaggagaaaactgacgagttaggtaactttgccagggtcacacatctagcaagtggtggggcaaggagagaactcaggtggtcttggctccaaagccctcaaccacaaggctctgctgcctacaagtttaatgcccagccctccaaggaagctcttttagtgagggctttaggggatgaactgcatggagtctttcatattctccaacctgatccatctg

SEQ ID NO: 83900 - DNA, 324 bp, Homo sapiens
gccaatatggtgaaaccccgtctctactaaaaatacaaaaatcagccaggcatggtggtgggcacctgtagtcccagctactcgggaggctgaggcaggagaatggcatgaacccgggaggtggagcttacagtgagccgagatcacgccacacactccagcctgggcgacagagtgagactccatctcaaaaaaaaaaaaaaagatatagtagaggaagtattgttattattgggattaaatgagtatgttttctgtttctggcatatagttcagagaaattcccggtttgggaatacagaagaggtagtcagaggaaaggtg

SEQ ID NO: 83901 - DNA, 418 bp, Homo sapiens
ttgaaaatgctgcctttcatctcaagaagtcaaacacatttgcagattattcctttttaaatgaagtcaaagctgacatatctatgagagtgcatgacaaatgtaaagaaacaacaatagaaaattgggcccatgatagaggtttgtttacccatgatacaggtatctgaatccactgatcaatgtgatgctataaaaactgatgaggaaggaactgtggcaaaaatgacagcatgctagtctgaggggagctgccaactggttgccacgtggtatggaactagtagttgccagatctcatttttctcaaagacccagaaatctggctttttatgtaaactctcaggattaaacgttaacataatgaaaggcatcttaacccccttctctgcttacttctagattgtgccaaaggcta

SEQ ID NO: 83902 - DNA, 152 bp, Homo sapiens
aaaataataattgataataatgctgtgatgaatatccacttgcataaatctgggcacacatttctgatcacttggtcagacaacatcctcgctttatagatgaggacagcagacccagaggaaagatttgccagcacaggcccatcatccag

SEQ ID NO: 83903 - DNA, 312 bp, Homo sapiens
cttgggtctcctgaaggacaacacttatcaaattcttttttcaaagtggatggtgctcatttttccgcattccactaatctcagtggaggcttcagcattctcttagctccgcattagcacttccaacatcatctctccactaagggaaaaaaaatgcctcctcctttgagattcatgccttctggctagtttacccttgtccctgctatctattaaactaatcataggctgggtgccgtggcttaaatctgtaatcctagcattttgggaggccaaggcgggtggattacctgaggtcaggagtttcagac

SEQ ID NO: 83904 - DNA, 382 bp, Homo sapiens
gggttgtactttaaaaaatgtgtacttttaaaaaaactcatcttctaaaacacaatgtcccctgaagttgcatgaaaaacctcaaggtggtttaaaaacacttgtaaaaaagaagaatctttcaattactagtgagattgaatctatctgaaccagaattactagagtcttaaaaacactgacacttaaaaataactatgtttgtcaatattcctaattggctaatcttaatttttgatgcatgtgggaactcactatagtaagataaaggagtttctgacactcaaggattttttttgtttgttttttaaggcttttttgtaaaggcatgaagaagcggcttagtgtttggtcctaaaaggcaaaagaatgtaagaaagaa

SEQ ID NO: 83905 - DNA, 840 bp, Homo sapiens
gactacttaaacaaacaaaaccagatcaccacctgtaacaacaccaaacaaacaaaaccaagaactaggaaaatgaggaaaaaatatctgactgaatgaaaattattacctgaagcaatacagaaggagtacttaatgttcaaataaagtcattgaccaaagtatggaacagaaaatataaatgcatatttttaaagcaaacatttcatctcctaaagacaagataagacatggaatgagaaggagaaataaattaatcccaccatccaacagtgaaagaaaaaacacagaacatgaggaggaccagaaagcaatgtgaaaaagagttgaaaggagtcactgctgagctattttagattctacaccctctatccagccatgaacctatcagcgatcatgcctaactattgcataccccattagacaacctaatgtgaatgtaggaagcctattcatctaaaggacatggaaccgagtagatgtaactgatacttcactattgacctatagcctattaagatctaccatgagtcatatacatttgacaccgtggttttcatttcataatacatatcttcactaattttgtctatcattttgtcaaagggctaaaactatagtaatgagtacattcttaatgagtttttctttaactaccacaatttgtatctaaattttgtctcatcttatgttctaaaattgtcacagcaaagtgatcaaggaagctagagattttacatatgttcttctcaataagatggctgtatctcttctatatcaagtaaataaatccttgatacatgaatgaagtaatggttcagtaaacaaattaaatatgat

SEQ ID NO: 83906 - DNA, 500 bp, Homo sapiens
tctgcattctcatgaataagttttaagtcgctttgaactaaaagtgtgtatgtgtgtatttatgtcagagttatgtgtatttccatttagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtgctcatggatgattttgttctaagcagttttcctcctgccctcccccgccccccacacgccc

SEQ ID NO: 83907 - DNA, 410 bp, Homo sapiens
tgctctagagttccctacggaatctagcgacatggaaggtgcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtg

SEQ ID NO: 83908 - DNA, 196 bp, Homo sapiens
agatcgagctcggtccctattctggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccgatgaataggaggtgccgatgaatagcga

SEQ ID NO: 83909 - DNA, 1560 bp, Homo sapiens
ggatccttaattaaattaatcccccctcttaaggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatggtaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtg

SEQ ID NO: 83910 - DNA, 1827 bp, Homo sapiens
ggatccttaattaaattaatcccccctcttaaggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaaggtgaagtcatttgccatgggccatgcagctgggaagtgacagatctggattcaaagcgagttctggctggcgccagagtccttgtattttacagcactggttctcaagctttatgtgcattaagaattcctgggttgagggtggcgttagttaacaaattctgggactctacaaattgagtagatctgggatggggctctggaatctattttcaacaattgttccctggcaaataacatatggctccccagtgaatggagcaagaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatggtaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtg

SEQ ID NO: 83911 - DNA, 1532 bp, Homo sapiens
ggatccttaattaaattaatcccccctcttaaggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggtggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatggtaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtgctcatggatgattttgttctaagcagttttcctcctgccctcccccgccccccacacgccc

SEQ ID NO: 83912 - DNA, 1261 bp, Homo sapiens
ggatccttaattaaattaatcccccctcttaaggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagagggaagagaatggagactacacatatgtggaaagagtgaagatacccttggatcatggtaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtg

SEQ ID NO: 83913 - DNA, 1497 bp, Homo sapiens
ggatccttaattaaattaatcccccctcttaaggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcagcagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggtggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatggtaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtgctcatggatgattttgttctaagcagttttcctcctgccctcccccgccccccacacgccc

SEQ ID NO: 83914 - DNA, 1621 bp, Homo sapiens
ggatccttaattaaattaatcccccctcttaaggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatggtaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtgctcatggatgattttgttctaagcagttttcctcctgccctcccccgccccccacacgccc

SEQ ID NO: 83915 - DNA, 1033 bp, Homo sapiens
gctagtagcgagctgcggttaatcggccgagggcagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatggtaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtg

SEQ ID NO: 83916 - DNA, 1322 bp, Homo sapiens
ggatccttaattaaattaatcccccctcttaaggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagagggaagagaatggagactacacatatgtggaaagagtgaagatacccttggatcatggtaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtgctcatggatgattttgttctaagcagttttcctcctgccctcccccgccccccacacgccc

SEQ ID NO: 83917 - DNA, 704 bp, Homo sapiens
ggaactggaatcgggccctctgtgagaagggagcctgaggcaaggccccaatttgcactgcagtggtgattggaggactaatgagaagtgtgtggcctgcgggccataggggtcagggggtggtggcctttggaactcttgcccactgaactgtggtgagcaattccaagttgtctctgggccaaatagagaaggaggatggaagatttcaattctgccaaaaagaaccatgaacaccagacccgcaatcagtaggagtacccgcggggccctctgctctctctatctagccttccgttggcactccagtgcaccccctctgctctccctgtctagccctccgttggcactccagtgcaccccctctgctctccctgtctagccctccgttggcactccagtgcaccccctctgctctccctatctagccttcccttggcactccagtgcaccttggcttcatgcccagggccccacccaacactgagggcattgccttttcctttgtcgcccccactttgtctacaaggaggaaaccacagccagagggagtgcaggcctcactggagcttcaggcctctccctatttaacacccctagggccgaccatgcttttagaaagacagtgagagactcagggcctgagaaggtatttctttttttccttttcctacctgacttgtaaatgaaagtttgtgaaagtc

SEQ ID NO: 83918 - DNA, 984 bp, Homo sapiens
aagtaaacaagtataagtgaaatttagacccaaagaataagtatttggggctcaattactccttaatattctgacatttcaggattgatttcactaaaactccctttggcatgatttgttattgttatgggttgtccagaaaaccataccaatagttattttcctgtcatgataagcggtcaagccaaggtgccttagtgttttgtttttcagtcaggaggttttgacagcttttccacgtgtcagtggggagggagaagttgagtggttgggacagtggtccccttcgtggtggaaagaacactgcctcagataatgtgtggctttcctctggtcagaggcccaaatgagtggacaagtactgtggtttctcaagcccctatgcagtgttagatgccactatgaaatacgagccattgaaagagatctcttcaacttattattttttatcacgaacgtacatatcagttatttatgagattttttttttaaatatttcattttttttcacgactttttctgccattgaattagcctttttctcatgcactggtggtcaagaaatacatgccataataagatggcagttaaacttcatcagtattttttttttttaaataagattatttagccaggcacagtggctcgcacctgtaatctgaacactttgggaaggccaaggcaggaggatcacttgaggccaggagttcaagaccagcctaggcaacataatgagaccctgtctctacagaaaatgaattcgctgggcatggtggcatgtgcctgtaggaagctgaagtgagaggatcacttgagcccaggagttcaagaccagcctgggcaacatagtgagaccctgtctctacagaaaatttaaaaattaactgggcactgtggcccgtgcctgtaggaggctgaagtgggaggatcacttgaacccaggagtttgaagctgcagtgagccaagatcacactactgcacac

SEQ ID NO: 83919 - DNA, 763 bp, Homo sapiens
tggtaccggccccgccgtttttttgtatgcgagactccatctgaataaacaaaaaaaaaccccaaaaaacaaaaaaacaatgtcatggtattagttaaggcaagtgatattcgctaccataacaaaaatctctaaaaatcttatggcttaatataattagaatgtactatttgccccggagaattcagacagatgtttgtttctgctctagtcactttccatatagtcattccaagtccagtcttcttccatcctgtggctccgacttcttccaagaccttaaaatcctttctccttccagcagatgcagaaggagagaatgtgtggaggattatgtagaaggatttcacgagcctggcctggagaggacacatcacttccaactccattccattaccagagcttagtctatttccagaagattataagcttcatgggggtagatgctttacttcattcatcactgcatctccaacgcctagcacagagtcctgaattacaggctcaataactatttactgaatgtgaaaacagagctgcttgaagatatatgaggctaattgagcttgtgcatttgttggctattgctgctacagtggatgctgttgttcagtattcagatatcaagaaacaactagccaaagtaaggaggaacgaggggcccatgaagctcagtagagcttgtgataatatttgcaagagaagactacctgccaaactaacttcagaaaaggtgttcttggttgaacatcgtcgttgcccc

SEQ ID NO: 83920 - DNA, 522 bp, Homo sapiens
ccgggtgtgtgccctggctggaccgaggggtttcctccgctcagtcggcagggaccctcgctgaggtgcgaggacacatggctgactctgaactcgcagcttcagggaaaccttccagcagtttctccaccgcggctctcacgttccccgtggcgcagcttcttcgtatcaccaatggctcggacacgcgggcgccacccctctcttgcccttgtcgttgttcttccttttgttgggaatgttctttcttcccttccacctgaggatccctcggcttccaggcccagttcagatgccccctcttctaggaagccttccagagtcctctcttctgggtttttacataaaatattaaaacttccccataggcctttgaaaaaaattcatctatttgaagtgcagagtcacatttttgtgaggcgaatgaactaatgggggtgagtctgatgcagagagggaactcgaacccagtgtgtcagacgcccgtgatcagtgtgatcagtgatggtgggtgtgcggccg

SEQ ID NO: 83921 - DNA, 93 bp, Homo sapiens
agagacaggattttgctctgtcacctaagctggagtgtagcggcacaatcagctcactgtagcttcaaactcctgggctcaagggatactccc

SEQ ID NO: 83922 - DNA, 297 bp, Homo sapiens
gtagagttctttcctatgatgacactgttctgcatcctgattgcagtggtagtaacatgaatgaagttaggctgaaactgcatagcaccacagacacacacacacgcacacacatacacacacgagagagagagagaaatggactcaggtaaaaatggtgaacagtgaataatgtcagttatctatttaacagtgtgcaaatgtcaatttcctagagcgaaactagtgaaaatttcatgggactctgagtacttttgttgcaacttcccatggatctaaaactacatcaaaactaga

SEQ ID NO: 83923 - DNA, 442 bp, Homo sapiens
  misc_feature (239)..(239): n is a, c, g, or t
tccttactctctatgctacagtaacactggcctcctttttgttcctcgaacacacagggtatgctcctatgcatgcactggctatttcctctatctggaatactctttcccctagataccacatgactcactacatcaccttctttagctcgttgatgaaacgtcactttgggcttggccggtggctcacctgtaatcccaacactttgggaggctgaagcaggagaattcacttgagncccaggaattcaagactagcctgggcaacatgatgagacctcccctctacaaaaggtaaactaaattagctgggcgtggtggtacatggcggtggtcccagctgctcaggaggaggctaaagtaggagaatcacttgagcctgggaggctgagggtgcaatgagtcatgattgtgccactttactccagcatgagtcacaaag

SEQ ID NO: 83924 - DNA, 346 bp, Homo sapiens
  misc_feature (106)..(106): n is a, c, g, or t
  misc_feature (328)..(328): n is a, c, g, or t
  misc_feature (330)..(331): n is a, c, g, or t
  misc_feature (334)..(334): n is a, c, g, or t
  misc_feature (338)..(339): n is a, c, g, or t
  misc_feature (341)..(343): n is a, c, g, or t
  misc_feature (346)..(346): n is a, c, g, or t
gaggagttttacattgcagcttagaagcctttcttccaatagcagagatttggtgtcatgtggtgttcatcagtttgaaaagaagtatttctgctgtttgcctcangatgtacatacagagatgtgctgattctcagaacttctatagaattccattagccagtcctgccaattgaaatttggcatttaattatttgcatttttctattcttgcctaggaaaggagctcgtcacatacctagtttagtgatggaaagtatttggagaaagttttagagagtggggctcaggctcaagaatacaatgaagtaataaagttgttaacctnannatnaaanncnnnatn

SEQ ID NO: 83925 - DNA, 386 bp, Homo sapiens
acaggttatagctactatgtggtaaacagaggtacagctctgcagcctgtttccttgggggaaaacaaccttttctttctgctgcttctgccttctctctccactcccgagaatgaccttattcatgagaacaatataaaatacctaagatcaaatagcaagaaatgcacaggattcagttgaagaagaatgatcaaactttgatgcagaatatgcactgaaatgtatatacatgtaaatttttgcacaggaaattgcaatattcaaataggactaattttccaggtgttctggtgaaaattgcaccacagtcccctcttcatgtctgatttcagctttgctcattcacaaactcttatttttctatttgtcattccatttccaca

SEQ ID NO: 83926 - DNA, 744 bp, Homo sapiens
caccactgtgtatgtagtctggtcattgaaacatccttatgcggtgcattactgaaatcttgaaacttgaaatacccataatatcttgggcaatgtcagggaaatgcactaatgggaagggcagtccccaagctgtaaacacaaagaaaaacaatgatgacacattgtggaccggcaagatgatcccttgataactgagtggaaatcggaagctgcaggggagatttgttgttctcaggcatagagtggctgctggttggcctgatgtcaatggcaggactctacaggggtaagagaatccagggaggcttctgtgcactgcttggtcaggtgggtactcaatgtagaagaagttctgcccaagtgccagtttttccttccagacatttttttttttttggaattttttggttgtgatcatagtggtgtgatgaattgggaattatgctggatatctgcagagtgttgctgtgcttagagtacaaaaccctgatagaagatgaagcctgcgggtggctcctaagacccttccaagggtccctccctcctagttttcatgcccgagtgtcatctcctcttcttgagtgtgggctggactccatgagtagcttctgatgacaagaatatggggatctctgtgttccgattgaaggttgaaacaacagtagctttttttttttttaactgccactctgtggccctgttgcttgatgttttaaaataaaaaaaaacctattatttatt

SEQ ID NO: 83927 - DNA, 158 bp, Homo sapiens
atgagaaagccctggctcagagaagtgattttcccagcgtcacagaggcagggaatggccgagctgggagaaccaaaaggagcttgactcgtccagcaagtattagtggcccacactggaggctcaacccactccaatccgagggcacgacgtcgacc

SEQ ID NO: 83928 - DNA, 1103 bp, Homo sapiens
cacattgccaccatttgaaggagatgatttaaggatcctggcccaggagatcaccaaggccagaagcttcctctggcaggcccaatccttcagatcccaactccagaagaaaaatgatgcagaaccaaaggtcactctttcctagagaagtgttctcagaaaagtcatcctgcaaaggaccactcactgagcaaatctcagccccgagggcaggatgggatgaaatgctgtgacctgcaggaaacatgattcctggtaccaggactctctggaagctgaggaaggaaagactttgtcttttgtgtgaggggccattcccgggtcttaatctaactctccagccctgtcccgcagcgcactctactctccagccactagattgtccctctctgggaagccctaaaccaaccccctgcctaaatggtggtgcttcttgcaaaccaaccccctgcctgaacggtgcttcttgccccctctgcctggagactcctgctcatccatcaaggcacagctcaaatgacatcagctccctgggacctatctagagcgaggggcctccagtctttctcttgcagcatcctgaccacgcagacctctcgcactcagcactctatgtcacgccaccttgctcgctgatctaactcttctccttgatggtgagctccttcgggatgagactggtgtcccaggatctgcaggtccccagaagctgccacataggagacacatggtgaacagtgagcaggcggctgagctgtgagagcctagctctggaaagcagctgatggggtggtctccaccctggttcataagaggctaatgcagagtcacagtcagcccatcctgggggaagaagaaacaagtgagcctcagcaccaccctccatccctgcccaaccaaactgaagtgaaggctgctcatctgggttcattttctaaaattaaaaacaattaattttattctactaataggatcaacatgactttaactgtttgaagtgatcattggcgtgtgtgtgtgtgcataaatttttagtgacataaaactttattaaaagactcataccataataaagaatttcaataagaaaaagataaacatcc

SEQ ID NO: 83929 - DNA, 2801 bp, Homo sapiens
tttttttattatagctatgctagtggatgtgaagtggtatctcattatggttttggttttcatactcctcatgtttaaggatgctgaacttcttttcatatgcttattggccatttgtgtatatatcttcttttagagaaatgtctatttaagtcctttgacccatttctgtgtccttacccctggtgaggtctcccttattctgttgcttggctggtccctatcctgccaatagtaatgggcccttcttcaccctgatgatggccctgttggcctgtcagcaatccctgggacctcttcttgggtgtgaattcctgggtaacatttctaatgaagtcaaccattcccaccaagtggaattcttagttaactggcatttctctactttcaggttcttggcatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacagtctgaggagaaaccctacacatgtggagcatgtgggagagacttttggttgaatgcaaaccttcaccagcaccagaaggagcacagtggagggaagccctttagatggtacaaggacagggacgcacttatgaagagctctaaagtccacctgtcagagaaccccttcacttgcagggaaggtgggaaggtcatcctgggcagctgtgacctcctccagcttcaagctgttgacagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaagtttcacactggggaaataccccatgtgtgtaaggagtgtgggaaggcctttagtcactcatctaagctgaggaagcaccagaaatttcacactgaagtaaaatattatgagtgcattgcatgtgggaaaaccttcaaccacaaactcacatttgttcatcatcagagaattcactcaggagaaagaccttatgagtgtgatgaatgtgggaaagccttcagtaacagatcacacctcattcggcatgagaaagttcacactggagaaaggccttttgagtgcctgaaatgtggaagagccttcagccaaagctccaatttccttcggcatcagaaagttcacacacaggtaagaccttatgagtgcagtcaatgtggtaaatccttcagccgaagctctgctctcattcagcactggagagttcacactggagaaagaccgtatgaatgcagtgaatgtggaagagcttttaacaataactccaaccttgctcagcaccagaaagttcacaccggagaacggccttttgagtgcagtgaatgtggaagagacttcagccaaagctcccatctccttcgacatcagaaagttcacactggagaacggccttttgaatgctgtgattgtggtaaagccttcagtaatagctccaccctcatccagcaccagaaagtacatactgggcaaaggccttatgagtgcagcgaatgtaggaaatccttcagccgcagctccagcctgattcagcactggagaattcacactggagaaaagccttacgagtgtagtgagtgtgggaaagcctttgctcacagctccactctcattgaacactggagagttcacacaaaagaaaggccttatgagtgcaatgaatgtgggaaattctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaaggacttatgagtgtagccagtgtgggaaactcttcagccatctttgtaaccttgcacagcataaaaagattcatacctgagtggagccttatggaagtggtctttgtgagaaaatcttcagccaagtcaaacttcatgcagcagaatccccataccagaaaaattacctccatgctattagctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgttctctagggattcaggactgtgctcagctgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtcacctttaatct

SEQ ID NO: 83930 - DNA, 1110 bp, Homo sapiens
tttttttattatagctatgctagtggatgtgaagtggtatctcattatggttttggttttcatactcctcatgtttaaggatgctgaacttcttttcatatgcttattggccatttgtgtatatatcttcttttagagaaatgtctatttaagtcctttgacccatttctgtgtccttacccctggtgaggtctcccttattctgttgcttggctggtccctatcctgccaatagtaatgggcccttcttcaccctgatgatggccctgttggcctgtcagcaatccctgggacctcttcttgggtgtgaattcctgggtaacatttctaatgaagtcaaccattcccaccaagtggaattcttagttaactggcatttctctactttcaggttcttggcatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacaagcataaaaagattcatacctgagtggagccttatggaagtggtctttgtgagaaaatcttcagccaagtcaaacttcatgcagcagaatccccataccagaaaaattacctccatgctattagctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgttctctagggattcaggactgtgctcagctgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtcacctttaatct

SEQ ID NO: 83931 - DNA, 350 bp, Homo sapiens
  misc_feature (270)..(270): n is a, c, g, or t
tccatggtgagcttattccaatcttaatggccttatatacagacttttttttttttccatatcccacatccaattcatcaggatgaattagctttgccttacaaatctttctagaatcgcaccacttcttacaacctccacagcttctagcctaagagtgttctctcatctctactaaaaatacaaaaaataaaaaataaatttgccaaatatggtggtgggcacctgtaatcccagctactggggaggcaggcacaagaactgcatgancctgggaggcggaggttgcagtgagccaggatggcgccactctactccagcctgggtgacagagtcaagactctgtctca

SEQ ID NO: 83932 - DNA, 507 bp, Homo sapiens
atggaaggcggggagcgtggaggggcgaggagaggctggagaccgccacggcgtcgagggaccccgctctcaccaggacccggggaccccggagacgagccccccgccaggccgcgccaccgcgcccatcctccctgcgggtcccaggcacccacagcgcggccgagcccacctgcccgccggctccccaggacgcagggtctcggaggctggggcggcggccggcctgaagcctcgcagccctgggcgcccccaccccggcccggctgtcgggtgcaccccgcattccctgcggtagcggctccctcgcgggcacccggggccgaggcctgcactcaccggccagcgtccgcaacacctcggccatggctccgcgtctggtctcggcctccgccttccgcccggcggccctggggcggggtgagcccgaggcgccccctcccggcccgcgccgcccgccgccccgacttcccgaggccgaacacgggaggggacagaggggcgcgg

SEQ ID NO: 83933 - DNA, 395 bp, Homo sapiens
gaaagtctaaagggggtaaagtgagtagctatgctgatattctctggtggaaataaatgttctctagccacactccaaattagagaaatttctccaattagatgcaacttggtgtaggacatttaacaaaatctcaaaagctaacagaattggggtcttacaagaaaaatgacacacttgcctgtagcctctaccgagatctcttccaacacccttgccagctattgctcaggcacaaaatgtgatgagaacacaaaatagccagacctccactcccactgtaacttggcgtgggaaaacaaaataattctaggcacaaaggacaaaggtaaaccagtcacatgcgttatatcagagcaaatagaatgtccaattgagctgcccaatcatgagca

SEQ ID NO: 83934 - DNA, 465 bp, Homo sapiens
agatctaaaggtatgatcagattcagctttacttttgtcaagcaaacttcttaggtaagtaggcagaaatgattagtagtctttgttcgcagcccttgattgtcagtgcctacagtcatttcagcaagcattgaatatattgatatttgaattctataacttcttttattaaatagaatatttttataaagataatttttcatgcctccactatttggttatcttgaggtatctcttacagaaaagggaggataaatgcttaattcttctccattatttactaggtttcacataatgaattgtttcgctaatatccttcaaaagtagccaatgaagctgggcatgctaggatgggcctgtaatcgtagctgctcctgaggctaagatggtacgaacctgtgagcctgggaggtcgaggctacagtgagccatgatcacttcactgcactactctgtctctttaaa

SEQ ID NO: 83935 - DNA, 227 bp, Homo sapiens
aagtatatttaagagatataaatcatacctattaacctttattgaatgtgtgaaatatactaggtacgatgccaaggaactttatgatacactgtttcatttaatcttcataataaccttatgagattattattataccccttcaaagactcagaaaggataagtgacttgcccagggttatacatgtattaagtgggagaatatgtcttattaggggaaggggtga

SEQ ID NO: 83936 - DNA, 865 bp, Homo sapiens
ctttactcaaatccttcttctcgctgaggctccctgagtatccacacataccttacctcctccacttttcctttttctcatggcactcgtcaatttttaacatactatatgatcgacttttatattatgcctgttgttcctttcctctccaccctgactcacaaaacatttgctccacaaggacaggagtctgttttgttattgtctatatgtctaaaatggtgtcaggcccataggaggcatccaaacttgtattgaaggaaagaatggaaataataggaaaatctccctcatatggttacagtgaagctcccgtgaactgataaacctaaagtgccggcacagaggaagtaccaaaatataagcctacgatgctcttgattttgcgatagtgaaatcccattataaaattctgcaatgccctgtcattttgtgactcagctataaatgcaaactcagtcctacccatcttggcttactaaaattggtaaatgtgagctccttgagggcaggattcacatatcctttgccatccttgaatcccaacacctagcacaagcctgacctctgggagaaatgttccttgacttgaaatagcttatcctttaattctgaaagcctaggatgtaggaagtgtcagtgttacaacagaacttttttcatttgactcagactttgaaaaacagtttgtgtattttgcatcagtatttctcaacctgggctacccactggaatcacctgggaagctggatcctaccttcagaaattctgactcgttggtcgaggtggggccagaacatcagaatttttcaaaggtcttcaggtgtttggaatgtgcagccatggttgagatacacagtctaga

SEQ ID NO: 83937 - DNA, 785 bp, Homo sapiens
atggcgttgaggaggctgtcaacatctcggagttcttcccatgtgcaaggcagggtgctgagcctgtgatgcgtatgtatgaagccgtgtcatgctcaccactcccctattgagcagtgtgcgatccccaacctctgatgttacacggaaccagctacccaacgagttgttttttacatttcccttttggtgttctatttatctggccttaaacaggcctggctgagaatatttaaaatcagagaacgcacggctggacacaaggcaaaccgtattccacacgcgcatttgcttaggagcagagttcagcaacgtgacgctgcctcccaagggcttgggttgttcccccatcctctctccacgactccgtcccaccttcccagtacttaaaagacgacggcagtaaccaacaatgaatgccccagctcaggagagcagctttgtgaccggaaggccacggcttccaggagcctgaggagggaaggtcagccctgaggagggaacagcacaagccaggctcgcgtgttgacatgaagggttctctgagcccagcctgagcaaatactaacacacaccgcctgtgctggctactgtctagcagccactggtcccgaaactccacacagtcaggccatctctgaagccgccaacacgcacctactttctgggcaagaacacaaatctgtcatttgcactcgtgtatttgcaatcggtgcgaacactcacagtctctatgctgcatgtggggaacacgcagccatttcaactatgaaaaaaaagaagac

SEQ ID NO: 83938 - DNA, 138 bp, Homo sapiens
  misc_feature (52)..(52): n is a, c, g, or t
gatcaagtcactgcatgttgagaagtataggtataacttgtgaccatatcanagctcctttatttatgtagtttcttcacattttatgtgtacaatcaagcatgcctgctgaccaaggccagaggtggagtggaagcg

SEQ ID NO: 83939 - DNA, 496 bp, Homo sapiens
aattgaagttaaggcattttaaagacaattaacataagttgttctcctccatcatctccaacatggtatcaataccacttgatgagggcttggcttacaccaattttattaggggccttacaaacatcatctcatttaatcttgcagcctcaaaaagtaggtaccataattcctattttatatataagaaaatggggccattcatagtggctcatgcctataattcccagtgctttgggaggactgcttggggccagaagtttgagacaacctggacaacataacaaagccccatctctacaaaaaggtaaaaattaaaagattactcaggcatactgctgtgcgcttgtagtcccagctacctgggaggctgagggaggaagatcccttacagccaggagttcaaagctgtatttagctatgatcatacctgtgcacagccacaggactacagcctggacaacatagcaaagactcttgtctctacaaaaaagtt

SEQ ID NO: 83940 - DNA, 307 bp, Homo sapiens
gaagcatttccattcttgctaataaagccaattggtccctcctgtgttttttgttgagatcttgaccctttccagatgatcttctttgacatgaccagatgtgaccccattctgactccttcttacaaaatgcccacaactggtccgtagggaaacactcacatattatgaaccccagagtaatttgggcattggtgattccccactcagcaaatttctctttgctcagcataagtagagctagacagtcacttggactttaggtttctcatatacatgggtcagacaccagtctatacgcacatca

SEQ ID NO: 83941 - DNA, 189 bp, Homo sapiens
atcagtgtcaatgtggactcatgtttttttaaataaatatataggtacagataagtaaagaagtaattatggatactcaacatctgtgaaaaaaaggaaaagataaaaataagaaaaagaagtaattatggatatgtatgtatacatgggtttgtatacatacatgtatttcctagctctgtctactgt

SEQ ID NO: 83942 - DNA, 172 bp, Homo sapiens
gtgtatgtgtgtatgcttatatatataatacatatttatttgtacatatgtgcatgtacagatataaacacacaaggatgtttatcatagagttgtttataaaagcatccaactaacatttctgtatctatgcaattgaaaacaacatagccattcaaagggatgaggcaga

SEQ ID NO: 83943 - DNA, 442 bp, Homo sapiens
atccatgtattgaacttcagttcagttccagtatacaaatatagcagtatcagaattacatactggtaccctcctgggaacaattttatcaagtagagtgtacacacacacacacacacacacttctgaaataatcagtaattttttaattgccatcgtatagaaactgaatatttggccttaaggaagatgggatttagatgaggagtagaatatagagaacttgctttctctctcactgccttattagaaagaaagaaaagaaaaaaaaaaaaatgccgggggggtttccatttgggggggcatgtttgtccccatcacttaaaaggctgtggccaagtgcgggtccagggaagcagagttggaaggggagggttagggacagggcttgggggaaagatccacgaggggaatagaagagttctaaatttgagaaggctga

SEQ ID NO: 83944 - DNA, 911 bp, Homo sapiens
ggaaggacccctgtccccgcaggctcgagggtatccgttccctccgcctgacctcttcctgcttaggacacctgctcccatgtcagagtggggcggagcctggacactgtcacagtccagccaggtgtgcccatgcttagggcaatgctgacaccccaggctgacaccccagccccctgtcaccttctccccctccagactttgggcactcgcaagtgtgaaaggggaagcctagaggaagctgagggtggttccggaactggcctgcaggtgccccttagtgccagcagcctgggtaccatgaatagccgcaggaggcagtctcctgggtggaagagggcgggtcccgggcaagggagggcctgaagactggggccatgctgtcagacccgcagacaggaatgggagcttgtggtacattttccaggcccacccatggcaccccatgaaccaatcagcacgcgcttcttccccctctgaggcccataaaagttccaatctcagccagagcaaagaagaggacacagagatgctggaacgaccaggtgcacacaggagctaccctccctactgaaagctgcagacgacctgcctgccaagtggagccacccactctagtgcctcctctcgctgagagctgcagacaacaagatgaccagcaacagagaggagctaccttgtctgctggtagctgaacacttgtgggaacgacctgcctacagagaggagctaccctttctggcaggagcttaatattcgttggtacaccctggctgtggagagaagctgcctccagcaggtcttctctgagctgttctatggctcaataaatctcctgtttgtcttgctcaccctccactttcttcctggtcgcaggacaataactcaggacccattgaacggtgaggcta

SEQ ID NO: 83945 - DNA, 959 bp, Homo sapiens
cttacgggccactttgttatgatgagtcctgggccctatggagccattgttgaggatttccagcagcacccagtctgcatcaacaacttctggaagcagagagtccctgaaccttggagcaaggagaggtatttgagattaggttgtttctgcttcctccgtttaccaatagggagagtcggatggagagaggcctgcatcaccctctggggcacatggcttgtgtggagggagcagcagctccttgggagttgagggtgcagaatcaggggcagcgtggatggccttggggtcaggccaccctgggctcaaatcctgactgttgctgtgccactgagcatgtgcctgagctctctgggccgcagtctcatgctggctggatgagtggcatctcagggctgccgtgtgccacgaaggcaccgagagcaggacttgtgcaggatgtgcgtccaccagtaccacacaccatcttcctgatgagggccagggcaaccaaggtcctttgtagacaccagcaccttctaacttggtgaggtcctggctgccgtgccgtgcatggagtcacctgcctgcaaacagccactctctatcctgctccagtccagtttgaaaaacaagcaaggtctattccagtgaagagccaccagggaagagtcaaggagggcatctgctgttcaaaccctgaccccctcttgctaatgatggcatcacgcttacttttagatgtaacatacagcctcggaggggttggaggagaggtccatggagatcacctggctcagccttctcgttttccagatgattttttttagtccaaagagactaaatgacttgactaaggccacacagcatgtcagcgggccagctaggactccacccacagcccctgagtctggggatccctgtgctcttggctctgagcaaggctgcctcacttcattttagtttagtctgtgtga

SEQ ID NO: 83946 - DNA, 647 bp, Homo sapiens
ggatcactctgtcgcccaggctggagtgcagaggcgtgatctcggctcactataacctccacctcccaggttcaagagattctcctggcttagccttccaagtagctgggattacaggcacccgccaccacacccagctaatttttgtgtttttagtagagatggggtttcaccgtgttggccaggctggtgttgaactcctgaactcaggcaatctgctcaccttggccccccaaattgttgggattacaggtgccacccggcctgatgacatgtttaatggacgtcactaccagcaattttagctgaaatctaggaccttttaaacaactttgaagtgtgtgatggatgcccctagtctagtgggcagaatggatcggaggtcggaaggtctggatctccttcgcagccgtcgctctgactcacatgacaatatttagaaaagcagattcttctgtcttgactccgttgatctctgctggacttccacgcttagactttgatggttgctattccacacattgctcccaggctccacatcccttcccaggaatcctgaatatggtagttggagagattcttgaacatcttgggttatatggaactctctacctctcaagatattcttttctaccttcggatagctc

SEQ ID NO: 83947 - DNA, 177 bp, Homo sapiens
ggcacattcaaccttcaaacctgggaaagatccaggtctggcgtggtctcagctatgaattcactcatgtgcctcactttcctgccccaccttcaagggctggcaccaggactccacagcccatgagtcatagacagcactgaaaccatggcccgggacctccatactgcaccatga

SEQ ID NO: 83948 - DNA, 658 bp, Homo sapiens
atggcttttctctggggggggatgggggagcttagttcatgtcctaagagaaaattcaccttcttaagtcaacaaaatgatgttttaaaagcctgaaggagcaaatcgtcagtagcacatctagaaccacaccaccccgatgccaccagggtggcctggtggcctcaagcatgatgtcaggtggagctctctgcactttgctggcagcagatcttcgcggagagaagcacggggagggtgacatgtggtacagagcaggaacgatggctctgtgcgatagcagcagacaaaggttgccatggcaagcctgctcaggaggtaggaggggatgctggtaaggtctgacgcttctggctgctgatgccgtgagcagaaatgtcctttcatcttcagtttttttcgaagcaaaaaattgtcttttcttccacaagaactttaaaacccaattaagagaccattttcccagaccacatttgtccagcctcacaacaacagtttgccatttgactcagacacgcatcactgcgctgacgcccacagctgtgattacagctctgaggggatcaataatgcaggctggctcacaggctgtcaccaggctcctgtgctctttggggcctcaccaattacagacaatcagccttgtctgctgagaagg

SEQ ID NO: 83949 - DNA, 228 bp, Homo sapiens
gctcacaccccgggagatctgaagtccaagatcaaggtgctaacaaggtcaaaatctggagagggccccgtccttggggtgcgcgatgtccaacttgtttttatgttctcacatggtctttcctgggtctgtgctcacagagagcactctggtaactcttcttataagagcctcaatcccataatgagggccccaatcccatgatctcatttaaacccaattatctcc

SEQ ID NO: 83950 - DNA, 277 bp, Homo sapiens
ttccttatatctacccataacatttatgctatgtttgtaagagaatatgaacatgaaacttaacactttataaggtaaaaatgagatggtttccaagatttaataattggatcaagttcttgttatttccaaatagaatggacttggtctgttaagggctaaggagaagaggaaggtaatggtaaaaattgtcaatgactggccgggtgtggtggctcacgcttgtaatctcagcactttgggaggccgaggcaggccaatcacctgaggtcacaag

SEQ ID NO: 83951 - DNA, 604 bp, Homo sapiens
ttctggggaacttatttatacacacatgccatatttcacagaggcacgcagtataactaagaaaaataagcaattttacaaatattatatgaagacggatttgttgattttaatttccaatttgtatacaattgagtggtgagataataaataataattcatttctccagtatcattggggacttaagtgaatttacaagaaaattagtttattctttctgttgctaaaatattttttgcttataaatttgagagagaaacatttttgaatatatagagaaacattttctgttttattaaacagagttctgagcataaacatttgtggggaatttaagaccactactctaaaaattaagtgttgtggcatgttataatatgagatcttgcttccagactctttgaggttcattgggtttagtacattcattcatttatcctacaaatgtttttagagtacgtgccaagtaccattgttcagatcactggagagtaagcattaggccaactaaaacttcatttcagatagagctttctatctagtgggagagaaagacaacaaaacaattaaatgagtaacaacataacatatatgtattatgac

SEQ ID NO: 83952 - DNA, 253 bp, Homo sapiens
ttttaagagttggcatctagttctgtcgcccagactagagtccaatgatgcaatcacagctcactgacctcaagcgaccctcccctctcagcctcccaagtccctgggattgcagcatgagccagccatcacacctggcagattagacacttcctctattttttattttatgtatttatctatgtattttttgagacagagtctcgcttgtcgcccaggctactttgcagtggcactatctcggctcactgca

SEQ ID NO: 83953 - DNA, 788 bp, Homo sapiens
cgccgccgccgctggccaaaaagcggagcccaggggaagcgtgtcctgctcagaccgccttccttctccattgccacccgtgccgaacagccaggctgcccaattgcaactgtagaccaatgaactaatccatcgcccgcagcccgactctcagcagcggttcgtcccggtgcccacccccgcgaagcggagcgcccgggcacctagcctccctgccggccacctagcctccctgccggccacgatgccgaacgtgctgctgccgcccaaggagagcaacctcttcaaacgcatcttgaaatgttatgaacagaagcagtacaaaaatggcctcaagttttgcaagatgattctgtcgaacccaaaatttgctgaacatggagagactttggctatgaaaggattaacactgaactgtttaggaaaaaaagaagaagcttatgagtttgttcgtaaaggacttcgtaatgatgtcaagagtcatgtctgttggcatgtatatggactcttgcagcgttctgataaaaaatatgatgaagctataaaatgttaccgaaatgccctcaaattagataaagataacctgcaaattttgagggatctctcactgttgcagatccaaatgagagaccttgaaggttaccgagagacaagataccagcttcttcagttgcgccccacacagcgtgcctcctggattggatatgctattgcataccatttgctgaaagattatgatatggccctaaaactgttggaagaatttagacaaactcagcaagtaagaa

SEQ ID NO: 83954 - DNA, 385 bp, Homo sapiens
tcaaacatggatgttttcaattttcactcatctagtagtatctttattttcaggtactgagaaactataatactggcttgattatgtagtcagagtaagcatattcaaccagaagggtctcattgcccttgtggttttatcttaatgaccgtctcttgataaggtaccatgactaaaaattatttgaggatttgagtagatcctatagccaaataagcccatagtaaaaatagcaaagattattttgaaaataaagtgtctttcttatacttaaagaaacagttcataatctttaacccatacccaaaatgaaacaagtgataggtgaatagttccacagagctatattgtcagataaataattttttcagagtaagtttaaaat

SEQ ID NO: 83955 - DNA, 455 bp, Homo sapiens
ccatctgcggtggaccgaccaaaatgcagattttcgtgatcacgctgctcctctgggagctggcaggaaatgcagtcgtgaacaagacacgttcccacctcacagccttagtgatcctccaggagctgagctgcttatacaagtacctttgacaccaggaagaagtgacgcagtctctgcaagaggaacacacagagccagggaagagaattctgggcctcaggctccccagccgcacaacctctgcagcaacccttgccctcctggacagagcctgggctggctcagagtccctgacttggcgagcactgcacccctcgttgtgggtaacacaaggtccgtccttgagtccatggtcagcatggactcggcctagccccactgagaggagaactgaggaaaggaaatgagtatttatttagggaccactttgtgccagcacatgtggcctcttc

SEQ ID NO: 83956 - DNA, 638 bp, Homo sapiens
gacgatgcagcaaagcaggactccttcctccatggaatgtgctgatttcagatgaggtggcagccagtgtagaaaacgtttcctagctcattttattgtaataatgcagaatataataacacaaaatatgtatcaattgatggtttatgttattggtaagggttttggttaacagtaggctatcagttgttaagattttagggagtcaaaagttatacgtgaatttttgactgcatagtcagtgctcccaagctgcacattgtttaagggtcaactgtatattgatcttatattaccatatatgtaatcttatagcatagagacttggtaatacgtactttgaaattgtgtgtgttccttgaatttgaagtgctgtttatgtttatatattctctgtacaacatattttatatatagaaaagccttgctgagttaagtataatgtatctgagataattatgggaatatttgttattttcttgtacaatctttgcagaccccaaaagtttttagaaaaattgaacacaagtgatccttgtatagattaaaatcttcatttattaaaggacctaagtatttctcttaaaaaaaaaaagcatgaacacacgcgcaaaagaccccggccctgaaaaccgagg

SEQ ID NO: 83957 - DNA, 351 bp, Homo sapiens
gacagactgaaggaatatatgcagcttaatttaacattttttgaaattttatattgcagaagttgtacatatttactgttgtgaaattagaaagaattgacaggcaaggagggtggtctacaaagcactccatagatccaccatactgagacaatgcttaatgctttgatggatttatttattttatactttctatgcatatgcatgtattgtataaatacgtatgcatggttaaatagaaatggttctccttggtgttctgtttatccatttattgttgtgaagtaaatccccaaagagtaggtttgctttgcctgaggagtcttttgctacatactgctgtacataatg

SEQ ID NO: 83958 - DNA, 338 bp, Homo sapiens
tagagtggtttcttttccccagtgtggactgatataacacaagataaaaaggaatttgaagacttagggagttatataaaacagatgtgaaatctgaataaactatgacatacagtgttgttaaggccttgagaattactctcaaacagaacttactgcagatagctgttagttttaggagatgtcttagtctattttctgttgctatagcagaatacctgagatagggtaatttataagagaagagtattttttttttcttatagttctaggggctggaaaatccaagatcaggcagccacatctggtaggcttccggtaagggtcttgtgctgtgt

SEQ ID NO: 83959 - DNA, 595 bp, Homo sapiens
ttagggtcgctgtcaatctacagaagttaacctgtccatccatgcacacattccaaccagtggtgatgtacttaagggtaaatctcaatgcccttagttttgaatagctcccagtatgtcccacacattaccattgatccttaattatagtaactgtgtgagtgatagataactgtcatctttgcagttagggcagaaggtatgtggctttcccagggtcattgggtaggcagtcactgattgggctggaaaagagacttgatgtgtagcttatacatgcccttctgcaccttctttccaaagttagtttcttccctagttggaattggatgtcctcaggtcttaaaacttgtgcagttgatgctacttctatctagactttgaatgatttttaactcggaccttggcagtaactcctagatagaaaatactgttaatttttttttttttaaacctcagggagctaattggaacctttccatttttcctatcctctgctgacagcttgtgatgtggaattaccttctctgaggaatgctaatgttaacatcatcaagagcaaggaatgtctctttgcctacttttatgaaacaag

SEQ ID NO: 83960 - DNA, 701 bp, Homo sapiens
tctcactagctgttttgggcatttaatactcttgagccagcagctctaccctgagtccgctggctttttccactgtcatacattttgagccccatgatccatttggctctccttgaatatattctcttctgatacttgccagctttgggctctaggtgtttgagattattgttgtacttaagggtaaatctcaatgcccttagttttgaatagctcccagtatgtcccacacattaccattgatccttaattatagtaactgtgtgagtgatagataactgtcatctttgcagttagggcagaaggtatgtggctttcccagggtcattgggtaggcagtcactgattgggctggaaaagagacttgatgtgtagcttatacatgcccttctgcaccttctttccaaagttagtttcttccctagttggaattggatgtcctcaggtcttaaaacttgtgcagttgatgctacttctatctagactttgaatgatttttaactcggaccttggcagtaactcctagatagaaaatactgttaatttttttttttttaaacctcagggagctaattggaacctttccatttttcctatcctctgctgacagcttgtgatgtggaattaccttctctgaggaatgctaatgttaacatcatcaagagcaaggaatgtctctttgcctacttttatgaaacaag

SEQ ID NO: 83961 - DNA, 325 bp, Homo sapiens
ttagggtcgctgtcaatctacagaagttaacctgtccatccatgcacacattccaaccagtggtgatgtacataaggctcatgttagcgtcagtattccccaaggaagcaagactgtctctgttttacaaaagggaaaataaggcaaagatgctgggattttcttatgatctgcaaggcactatgcagagccaagaaaaaaaatttgcaggttttgctggcctcagcaaaatctctggtggttctgtgctaggtttcaaccaatttaacataggaagtttaacatataccaggtgcgtgactcacgcctgtaatcctagcatttt

SEQ ID NO: 83962 - DNA, 207 bp, Homo sapiens
aatacattggatgccatcaaaagataaatatttttgcaccacaaggacggctatcaacaaagtgaaagaacagtctacataataaaggaagaaaagatttacaaatcagatatctgataagcatctagtatctagagtatataaagaactttttcttcaacttttattttagaatcaggcagtacatgtgcaggtttttcacatggg

SEQ ID NO: 83963 - DNA, 611 bp, Homo sapiens
ttcttcctttcttctttctttctttctttctttctttctttctttctttctttctttttctctttttccttcttttggcttcttagtggtttgaatacaaggcgtggtgaagagatataaattacacaagaaactacaagctatgtcatatgtctacctctctagctgacaagggaagcaggggaaatttctcttccaattgtctgctctgaaggtcatccaaacataattatcaggtggggtgggtgaactcttttattcttttaatcatccaacaaatatttctcaagcgcataccttgttaagagactgttttgggtacagtaattcacagtgaataaaacacagatattctcacctttgtgatactacgtcatagttgcaaggagtggggagaaacagacaggaagcaaagaagaaaaataaacaagaagtcatgtgataatatctactgggagggactcattaggcagtaaaggactcggcagtgtggaggtgacacattcagttttcagtagaagaatcagggaagttgtcactttgaagctatcatttagcttccctttctttcaatcttctttctttacatgggaaataaggattgtgggata

SEQ ID NO: 83964 - DNA, 443 bp, Homo sapiens
tcaggaggctgagacagaagaatcgcttgaacctgggaggcagaggttggggtgagccgagatcgcgccactgcactccagcctgggagacagggtgaaactatgcctcaataaaaaaagaaaaaaagaaagaaaaaaaaagaaagatggcaagatggaaaatgagaaaataaatgggaaacaaaagacacacatgcaggtggacagtgagaaaaaacacctcgatttctgaaaagactgagcaagatggcgattgggagacagaaggctgggggctggggtcaggaggaggacggggagtggtgtggagacacatgtagattattaccagaaaaaattcatgttcctaatacctaagtctatcagtgtgagccaaaataagtggaataaagacatcttgacaaggatggcttagaatcaaataccatgtttataatatatca

SEQ ID NO: 83965 - DNA, 797 bp, Homo sapiens
tccataaacagtcttgcgtcttcagatctgtgttagttttctattgctgctgcaattaattactgccaatttagcggctgaaaacaagaaaaatttgttatctgacagtctggaaatcagaagtcctaaaagcaaggtgtcagcaaggttgtgttatttctggagatgctaggggagaatccatttccattccttttccgatttcttggccttcgttcttgtccttgcatgtagctccctacgttgtagaaccagcaacaacgtgtggaatcctgaggctgccatcactcaggctctctgcagttgaggaatgttccccacaatttcaaagactcacatgattagatcaggttcccccggacaatccccatcccaagatccttaacttgaatcattactgcaaagtcccttttggccatgcaagctaacatgttcacaggtaaccagagttaagggatgggcatctttggaggcttttattcagcagccaccatatgtgaaaatgagaatgagaaaagggttgaatttctcctgactaggcatttacgaaactcagagccatgaaatatatctagttgtcttaacttcaagttttgctttgccttcttgacctcttctctgctattgcctctttcctatctatttgctgtttttaatgtgttaagtttcttattatacctgtgcttttactacaaatgaatagtggttttattttttccttcactaacaagtaaacaaaaataatatttgcagtgcatatttaatacttcagccttttaacttgccaaacagtaatg

SEQ ID NO: 83966 - DNA, 2108 bp, Homo sapiens
ggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaaggttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagaagttgggttcttgagtttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttctagtgggaatgtgtcctttgttttagttcacaagtagtaattttgacaagatgctttcttctgatgcagtttgttttaatcactcacctagtactagaaatgggctttctagtcagatcctatagtctctacctgtatagctcttacatacatggcccctactgataacccctgaatgaagcaccatgtagaaaatatttcctgataaatctgtatgtatttacaaaaaaaaaaaaaaaaaaaaaaaaaaaaaaaaaaaggggggggcgcgcggctcaaaaatttctcccttggggggcgcccaagttaatagggtatccccaggtttttttgtcacaaggggggctcccatataaggaggaggcggtattaataaaggcatagagaagagggccgcgttgttaaaaaaacgttctgtagacgtgggaaaactgtgatcgctggggaattctgggagaagggaccgctattctcggggggggggaacattgtggacaacttccattacaagaaatttaaaggctcaggcggaattataaaatttcacgtgtatatggtgttaaaccaggtgattttg

SEQ ID NO: 83967 - DNA, 583 bp, Homo sapiens
ggggattcatgggattcaggaaaccagagttgcagccagtgaaacagcaatcaaaatgacctgagcacacaagctaggcagagcctgctgccctcagtccaactggaacgagttccagtccaactggaatgagaggatttcggggaggaaagtggaaattctatattacttattcattgactgcatcagacaatatattaatccatatgtgttttgaaaatctagaagtgttttacagatttggagaaaattagcaattggtcctgagaaaataatcaaatttaaaagaccttaattaactgcaagaaaaagtcgagtagaaagtataatcataatacactactttgctcaacagtcatgaatatttacataatgataacgttgaatacctctaaaatatgatatttatactctaggtttggagagaatagaactatttaagttagcataaatacttatacatgaaagtaaaaaggtaatatatagtatctaaaatttagaagtcaaaaattacaataagagtatgttatctgaaaatatggagttaaattacagaagagatagctgaaagaattgaaaatgt

SEQ ID NO: 83968 - DNA, 338 bp, Homo sapiens
ctactgtcccataagagacagcccctgtttgtggccatttctggacatgtttttctcaataaagtaacatggatgtgggcttttagggtgagtaaagtacagttttataaaaattttgtaatgtgctagtgttcccgtactttttactgtctggtatcctaagcatgaagcatgtccaagtttaaagtaggaaaacaatagtcctagtgatgccgagaaactcaattattcctcagaatgccatggtcatctgcacacaaaatgtacctttaatgtgactgtgtaatttgtaaagttgacaaataaagtgctatgaatactcctctcctctttgtgga

SEQ ID NO: 83969 - DNA, 463 bp, Homo sapiens
tgcatttgagtggaacagaaatagaacttgttctctgaaggaaaaggtccaaattaacaaggataaaaatcccaacatctcagccttgaggaccagattcaaatgaataagaactctggctatgtatcattaagaaaagccagataatggagaaaggaatcctttgatttcactatcagctgcaagcataaaaaccacatgaccaagtaattccatggcgggctctgagacagcgacttccaaagctgcctgcggtccagaggtagaacaggagggactagaactctggaactgaaacggtggggccttacaagccacttaacctctctatatcccttcttctaaactaagagcagcagtgtctaccttacaaggctgctgtgagaattagggagatatacggtaaagttaatcaaactgtaaatttagcttaggtgaatttgtgtaaggtagaaaggcagga

SEQ ID NO: 83970 - DNA, 1905 bp, Homo sapiens
gaaagagtaaaggcagagtggcagttaaggaggtgatttttccatcaggggttaggtgaggaaggcctgaattagggcagtggccataagtctcgggggcggtaggtaagctgatgagttctttgggaaataaagttttcagatcttgacacttctttgagttatgagtgagggagaatgagttgtcaaggatggcatccaagtttctggcttgtagggtttactagatagaaatgaaagcaagtctctgaaaacaaacctaatctaatagtcatcctacatactacagctgcagcctcccttccccagctggtcacagcccaaatgccaagggtgaggtcacagggcctctgtggtcaaaatccaggatctccacttcccaattccatcctgactccatctcaccattctgcaagctggtgtcaattcaaccaccctccatatactctgctcaagagaaggaaaagatgaggaatgagaaaggaaaaacattaaagacagtaattcttccttcaaaaaatggggaaaggtaaatattccatagggctctggcagtaaggaagggaaaaaagatgggaggccagtcatgcagccatcggccatgtggctacagcttccttcttccacctgcccagtccttattctcctgtcttcaggcaggctctcactggttggggttctggatccagagcggcaactctaacctctgttcctgaggctcttcaacccttggtgggactctgattagagtagcagcttcttcagcccaccgttccgcggggcattgtgccccaggtgttctctggttcctcctgtacctttcctggccacaccagggtgtggtaacaatcacaggacaccctgagtctcagggtcggtcatcagcctgacattctgacccccttttctgtctcttcctaatgccacagggagcctcaaatggcacggtagaaatctcagcttctaaagggattatgacattgtgccctgtggcttccttccctcctttctttccttctttccttccttccttccttccttccttccttccttccttccttccttctttccttcctttctttcttctttttttctgagacacagttttgctcttgttgcccaggctggtgtacaatggcctgatcttggctcactgcaacctctgcctcctgggttcaagtgattctcctgcctcagtcttcccaagtagctgggataacaggcatgcaccatcacgcccagctaattttatatttttagtaaagatggggtttctgcatgttggtcaggctagtctcgaactcccgacttcaggtgatccgactgccttggcctcccaaattgctgggattacaggtgtgagccaccgtgcccagcgggcagcattcctttcttgcatgcccagaccttcacactgttgattaggaggacaagaatgataattctgagagtgggtcattgatgccatctgagccatcctttccctcctctagcctatagatccttgagttttttagccatgaagggaaaacactgtaagttgtttctggttccattcatagcacagccagcaaccttcctgacatcacttagtctttgcaaagtggtgtccacctacctggcaccaccctgggtctttactaggacagcctatcactcagccacttgcttctagataacagacacatggtgagatcagcaaatcctgtggacagtagccccaaccttatttctttgtgtttctttggtagttttattttgaagaattttagatttacagaggcattgcaaagttagtacagagagttcccatatacccttaacctggcttcccctaatgttaacatcttcataaccatggtacttttaaaattaaaaaattaacatttgtataaaaaagttaac

SEQ ID NO: 83971 - DNA, 589 bp, Homo sapiens
actttaccagcaacaatgaaaagtagaaaacaatgtcttcaaaattcagaaggaatatgattatcgagtagacttacaaagctatttgaaaatcaaaatgggccgggcacggtggctcacatctgtaatcccagcactttgggaggctgaggcaggtagatcatcagaagttatgagatcgagaccagcctagtcaacatggcgaaactttgtctttactaaaaatacaaaaagccaggtgtggtggcgggcgcctgtaatcccagctactcgggaggctgaggcaggaaaatcacttgaacccaggaagcggaggttgcagtgagccgagattgtgccactgcactccagcctgggtgacagaatgagaccccatctcaaagtaagtaagaaaataaaataaaatcgagatggttacccaattgttcaaacatcttttaatggcttatctctcttttctctttggatttaaaatgccacctttagcatatataattatatattactgttttgcttacctttaacagaaaacttaattgctttagatggtagtggtcttcctgcataagtgtctgcattactttcattc

SEQ ID NO: 83972 - DNA, 1740 bp, Homo sapiens
  misc_feature (577)..(577): n is a, c, g, or t
  misc_feature (579)..(579): n is a, c, g, or t
actaagtggtgatgagcatgagtaacaattggaaatctcatacattgctggtagaaatacaaaatggtaaagccatttggaaaaacaataggcaatctcttataaacatactcgtccatttgacatagcaatcctatttttaggtatttatccaagagaaatgaaagcatatccatacaaacacccgaatgtgaatgctcatagtagcctaattcaaagtagccctaaactagaaacaatccaaaagtctaacaactggtgcatggataaacaaattgtggcccatccacataatggaaagctacccagcaatggaaaggaacaaacaagtgatacatgcaacaacatggatgaatctcaaaagcactgtggtcagttgaaaaaaaaaaaaggcaaacacaaaggagtacataccatatgattccacttatatgacattctagaaaaggcaaaactatagggacaggaaacatcaatggttgccagggactgtgggtgaggagaggagacttgactataaaggaacatgaggaaatttttcagggtgacagaaatgttctgtatcttgatatggtgntntaaaagtgaggtataatttatatacagtaaaatgcacaagtcttaaatgtacaactcaattaatttttacgtatgtatacaccatgaaaccttcacccacttcaacatacagaccatttccttcaccctggaaggacccttgcaccttattgaatcaatacctagtcctccggaggtaaccattattctgatttctaccaccatagattagttttgcttgattttgaatgtcatatgaatggaatcatatacttttttgtttggcttttttttttttaatctcagcataaagtttttgagattcatccatgctgttctgcatattacaacatttttttacttttattattgctggtgatattccattctctgattatatcacaaactgttctatgtttttcttgatggatatttggattttgtcaagtttttggctattagtaattaagtggctatgaatattcttgtataagacttttggtggacatataaactaatttttcttgagcatattcctggatgtggaattgctgggtcctatagttggctttataagaaactgctggccaggtgcagtggctcacacctgtaatcccagcactttgggaggccgagatgggtggatcacttgagctcaggagtttgagaccaacccggcaaacatggtgaagccccgtctctactaataatacaaaaattagccgggcatggtggtacactcctgtaatctcagctactcgagaggctgaggcacaagaatcacttgaacccaggaggtggagtttgcattaagctgagattgcaacactacactccagcctgggtgacagagtgaaactgtgtctcaaaaacaaacaaacaaacaaaaaacgaaacaaaggccaggcgtggtggctcatgcctgtaatcccagcactttgggaggctaaggtgggcgggtcacctgaggccaggagttcgagaccagcctggacaacatggtgaaaccccatctctactaacaatacaaaaattagccaggtgtggtagcacatgcctgtaatcccagccacttgggaggctgaggcaggagagttgcttaaacccgggaggcagaggttgcagtgagctgagctcaccactgcactccagcctgggcgacagagtgagactctgtcttgg

SEQ ID NO: 83973 - DNA, 831 bp, Homo sapiens
  misc_feature (760)..(760): n is a, c, g, or t
  misc_feature (764)..(764): n is a, c, g, or t
cgacatcagagatgaggacagcattgctgctccttgcaaccctggctgtggctacagggccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccgcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttatttttgtactcaaatctctacatggagataaatgatttaaaccagcagaaaaaaacaaaaaaaacacncaanaaaacacacacaaaaaaaaccggggtcttcttgggggggagaaaaatttaaggcagatatgttccac

SEQ ID NO: 83974 - DNA, 2111 bp, Homo sapiens
tggtcaccaaatactaggagcctggagctgacgacatctaggcacagagaaccccgacactgtgggtgctagactcttcaaatttaaaacaacatggagcccgaatcttaacgagtgtcagatttacaatgtttcagaatctgaggatcttagaactgactcctggagtcacggaccctgagagagtggagcagggggttgtcttgagatgcttctcactgggagagcggccatctagtccctgccaccagcccctcccggtccccaggtctcccccagcacagcccaggacagcccaaaggccaccaagcccttcctgtcataggctcagagcagccaagctggctgcccccggggccttagctccgtcaggccctcagaaacatagccatctcctccagggacatcccctggggtggggacaagagccagtgtcctcttggcagtcgcagagctccctgagaccttggaggaaaggcttgcaacacaccctagacaggggcagggcaggacacctcttccaagccggcccaggctggaatacatgtcccctgaggctgcactcagggcacatgccctgccaggacccagagcccgggtttgggggcctagggcaagggcagcagggcctctgtccaggaggggtctctgcaggtgggggagcaggccctgctgagtcaccaggaggcctctgttgggcccgctgagccggactccctccccgccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccgcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttatttttgtactcaaatctctacatggagataaatgatttaaaccagaaaaaaaaaaaaaaaaaaaaaaaaaaaaaaaaaaggagcggaacaacaataaccgagggggggcgcagcaaaccgggggctactgaacaacgggcgccgggtccacacagggcgttcccgagcccccagtgttcgttcgaaccacagggtggaacaacccggcggcggctgccaccaatgggagggcaccctgatgaagtaccccaacaagcacggggattacccgtgatgttagaaaccgcggcggcaggcagccgggctaagaataaccggcgcaacacacggcgcgcgaaccatccgagccagcaagagaccctgccagtaggaagcggacccgagtacgaggggccgcgtacacccgagggccgagcacccgcaaaaaaccacgcaccggccagccgcgagacaaccaaggtacgcccacagcacgacagcacagtcagaccgcacgcaccgaacggaaacaaaggcaggaaaaccggatagcagcccaaccgccgataccgcagggacgacacccagagcaaagcgagccgaggcaaccacacacaaccggaagcaacaccgcgagcgcacaggccagcaaggagacgagggaactgacacaccacacaaacgacccaggacgggccgcaaacacggggcacacaaccgcaaccgcgaacgaacccaaccacggacaacggacaccgcagaaccaccagcccgt

SEQ ID NO: 83975 - DNA, 1961 bp, Homo sapiens
tggtcaccaaatactaggagcctggagctgacgacatctaggcacagagaaccccgacactgtgggtgctagactcttcaaatttaaaacaacatggagcccgaatcttaacgagtgtcagatttacaatgtttcagaatctgaggatcttagaactgactcctggagtcacggaccctgagagagtggagcagggggttgtcttgagatgcttctcactgggagagcggccatctagtccctgccaccagcccctcccggtccccaggtctcccccagcacagcccaggacagcccaaaggccaccaagcccttcctgtcataggctcagagcagccaagctggctgcccccggggccttagctccgtcaggccctcagaaacatagccatctcctccagggacatcccctggggtggggacaagagccagtgtcctcttggcagtcgcagagctccctgagaccttggaggaaaggcttgcaacacaccctagacaggggcagggcaggacacctcttccaagccggcccaggctggaatacatgtcccctgaggctgcactcagggcacatgccctgccaggacccagagcccgggtttgggggcctagggcaagggcagcagggcctctgtccaggaggggtctctgcaggtgggggagcaggccctgctgagtcaccaggaggcctctgttgggcccgctgagccggactccctccccgccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccactgcatggaaggtggaggacagaagccctgtggatccccggatttcacactccttctgttttgttgccgtttatttttgtactcaaatctctacatggagataaatgatttaaaccagaaaaaaaaaaaaaaaaaaaaaaaaaaaaaaaaaaggagcggaacaacaataaccgagggggggcgcagcaaaccgggggctactgaacaacgggcgccgggtccacacagggcgttcccgagcccccagtgttcgttcgaaccacagggtggaacaacccggcggcggctgccaccaatgggagggcaccctgatgaagtaccccaacaagcacggggattacccgtgatgttagaaaccgcggcggcaggcagccgggctaagaataaccggcgcaacacacggcgcgcgaaccatccgagccagcaagagaccctgccagtaggaagcggacccgagtacgaggggccgcgtacacccgagggccgagcacccgcaaaaaaccacgcaccggccagccgcgagacaaccaaggtacgcccacagcacgacagcacagtcagaccgcacgcaccgaacggaaacaaaggcaggaaaaccggatagcagcccaaccgccgataccgcagggacgacacccagagcaaagcgagccgaggcaaccacacacaaccggaagcaacaccgcgagcgcacaggccagcaaggagacgagggaactgacacaccacacaaacgacccaggacgggccgcaaacacggggcacacaaccgcaaccgcgaacgaacccaaccacggacaacggacaccgcagaaccaccagcccgt

SEQ ID NO: 83976 - DNA, 1446 bp, Homo sapiens
cgacatcagagatgaggacagcattgctgctccttgcaaccctggctgtggctacagggccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccgcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttatttttgtactcaaatctctacatggagataaatgatttaaaccagaaaaaaaaaaaaaaaaaaaaaaaaaaaaaaaaaaggagcggaacaacaataaccgagggggggcgcagcaaaccgggggctactgaacaacgggcgccgggtccacacagggcgttcccgagcccccagtgttcgttcgaaccacagggtggaacaacccggcggcggctgccaccaatgggagggcaccctgatgaagtaccccaacaagcacggggattacccgtgatgttagaaaccgcggcggcaggcagccgggctaagaataaccggcgcaacacacggcgcgcgaaccatccgagccagcaagagaccctgccagtaggaagcggacccgagtacgaggggccgcgtacacccgagggccgagcacccgcaaaaaaccacgcaccggccagccgcgagacaaccaaggtacgcccacagcacgacagcacagtcagaccgcacgcaccgaacggaaacaaaggcaggaaaaccggatagcagcccaaccgccgataccgcagggacgacacccagagcaaagcgagccgaggcaaccacacacaaccggaagcaacaccgcgagcgcacaggccagcaaggagacgagggaactgacacaccacacaaacgacccaggacgggccgcaaacacggggcacacaaccgcaaccgcgaacgaacccaaccacggacaacggacaccgcagaaccaccagcccgt

SEQ ID NO: 83977 - DNA, 1077 bp, Homo sapiens
tggtcaccaaatactaggagcctggagctgacgacatctaggcacagagaaccccgacactgtgggtgctagactcttcaaatttaaaacaacatggagcccgaatcttaacgagtgtcagatttacaatgtttcagaatctgaggatcttagaactgactcctggagtcacggaccctgagagagtggagcagggggttgtcttgagatgcttctcactgggagagcggccatctagtccctgccaccagcccctcccggtccccaggtctcccccagcacagcccaggacagcccaaaggccaccaagcccttcctgtcataggctcagagcagccaagctggctgcccccggggccttagctccgtcaggccctcagaaacatagccatctcctccagggacatcccctggggtggggacaagagccagtgtcctcttggcagtcgcagagctccctgagaccttggaggaaaggcttgcaacacaccctagacaggggcagggcaggacacctcttccaagccggcccaggctggaatacatgtcccctgaggctgcactcagggcacatgccctgccaggacccagagcccgggtttgggggcctagggcaagggcagcagggcctctgtccaggaggggtctctgcaggtgggggagcaggccctgctgagtcaccaggaggcctctgttgggcccgctgagccggactccctccccgccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccaccctgcgctgccacgtgtgcaccagctccagcaactgcaagcattctgtggtctgcccggccagctctcgcttctgcaagaccacgaacacagtgct

SEQ ID NO: 83978 - DNA, 493 bp, Homo sapiens
ttctgggattacaggtgcaagccactgcacctggcccctgaacatctcatattccacaagaaggtctatttcaggacttggtagacaggactgcatacccctaagccactggtgtgctggaaaatgtttaattaccagctcttgagaggatggagatctcccctcttgtggtatttgctaatttcccaccacagccaatgtcaagctgccaacatgacctcactgaaagtggaccagaggaggggaatgccattggctgtggtgagctgggaggagcaattctggtaccatggccaccagcagtcccagtgctctacagccaagccctgagatctttgcacctgatagtcttacgcctgatcacgttacttatttattttattttgttttttcttttgtcagacctggtcaacaggaagtaattgcctgagctctttaaagcaactgagctgaatgtcaggaaactggagtcctaatccaggcccttttttga

SEQ ID NO: 83979 - DNA, 665 bp, Homo sapiens
ctatgacagccaccaagcttggtccaaataatagatcttattcagaggagagaaagaatcctgaagactgagaaaggcataaaacctttcctatagaagaggaatgtggggcgggtggcagagggccataggaagctgcctgtgcttttcagcagaagggcagcaagaccaatcaagtgtgagaatgacttaggggcggtgtgtacagtacactgaaatgacgtagagatgaaggggcaaattgcttccaataattatacagccatgaaaaaaaagtattatatttctagatccagaaaagcaatcatagaagctaagtataaagaagtcgactacaaaacaatatagataacataatcatgatttgtaagacatgtttcacatttggatagatgaggatattttgatagatacacgggaaaaagtctagagggataactatcacagctcaatagggacattatctgaatggtgaaatgtgtggttttcccgtccctcccttccttccttccttccttccttccttctttctccactcccgaaggaaggaaggaaggaaggacggacaggaggaaggaaggagagatagcaaagtggctccatcaataaaatgtatatttccttcaacctaagctcaatcattctctcttccactccccgggtac

SEQ ID NO: 83980 - DNA, 759 bp, Homo sapiens
atgcttcatattaacatagaaaagaaatttcttcacctatctcctgagtcttttgaaatcttcacatatattattttctaaattattattatttaaaattttcttaaagatggagtcttgctctgtctcccaggctggatagagtacagtggcatgatcttagctcactgtaacctcagacttctgggatcaaacaattctcccctcagcctcctgaatagctggggctacaggtacatgccatcatgcatggctaattttttaaaatttttcgtagagatagggtctcgctacgtagtctaggctgttctcaaactcctgggctcaagcaatcctcccacctcagcctcccaaagcgctgggattataggtgtgagtcaccatccctggctctatttttattatttaaaaaaaaattatatgtatatataaattccagtgaattgatagaggcagtacttcctatttgaagcatactagaatggctgaactctcagttgctgatgcctgaaattttatattggagttcattccttaggttaacaatttaaatcttaaatatctaatgaagggataatttggggggccttagcagtcattttcacttagatctttgtctgaaggtaggttcttaatatgcgggaaggcagagagagcttgagggcctgcctgtaccccaaacccctgtcttctcactcaggccttatattatgaagggtctggactttaatattatcttcaaataaggccatgtatgta

SEQ ID NO: 83981 - DNA, 310 bp, Homo sapiens
ttatacagatgtggttttgccatgttgcccgggctggtcttgaactcatgcactcaagtaatccacctacctcagcctcccaaagtgctaggattataggcatgagccactccgcctggctatgtgaagaattttaaggccttgttacatattatttaaacattttttagaatgacaaaaaagtttgggaaatagtgatgatgattgaacaacattgagaatgtacttattgccactgaaccatatggctaaaaattattaaaatggtaaattttatcctaggtatatttactataataaaaaggtcaaa

SEQ ID NO: 83982 - DNA, 514 bp, Homo sapiens
tatttgataatggactctcatatttttacattttctctaactagaacatatgctttagaggggtagaaaccatgtcttacattttccagtttattgcctgcagcatctggctcactgaaggacacaccgtagatgctcagtaatgtctcactgatcagtgtgagaaggaggtatcaggaggagattatcgggggtatctgctgctggagatggttgtattctgcttaggaatgatacagaatagcagacaatcctgaataggaagaatttattgtgtcagggggacaccagggtataaggctgaggccccaatgagaaatgcatgcctacttcctccttctcttcatggaatgagtaattgaacttcaagtgtcaggcattaagcgaagacagctgtggcaatcattttgttaatatatgagatgctggagccaaggtaaccagaaagagaaccaagcctttgagtgacagaaacaaaggcaggagccaccagtcgctgggtccaactagtcct

SEQ ID NO: 83983 - DNA, 869 bp, Homo sapiens
cagccctaggagagctgctcagggagcctcccctgtgggtgtttgctcctccccaggctgtggcccatttccccttcctccttcctgctcagcccaaaggcaggagtcatggaaccccaggaaaggacggaacagaacaggacagggcccccagccccatctttatctcaccggctgctgctggctgccaagcctcccctgaatgggggagggtggtctgtgtgagtcagcggaggcacgaagtggaggaagacgggagcctctgccaggcccgttgatgcgtggcctcagaaatgcgccgctgggttagggtctccccgaccgaggctcgaatccaggtcgaagggtcgccggagcgatggttggagaatgtggaaggagctggaggacacccgagtattcttaaagcaatccccatggccaaaatcaacagctgatctggataccatcaagacacctgaaatcttatcatgagccagatgctgaggaagagactccgggaggatcccgaggacggcccagttgcagccatgttgagactgacgctgaggaggaccccaactgtcacgagcaacacctgtcgaacacagccacccacctggggacagatcaagaagctgtcacagatggcagaagaaaacctgaggaaagcgggacaaccagtcacaatgagtaatttcatggtagctatgatagcagttatcaccactgctgtgagtattccttcaacaagggctgacacacagaacaattatacttattgggcatatttatcaaccttggctggcaataatgcctagatgtaatcactctatgacacagttacacatgctttctgatctcagtatttaccataatctgctcctata

SEQ ID NO: 83984 - DNA, 1099 bp, Homo sapiens
  misc_feature (487)..(487): n is a, c, g, or t
cagccctaggagagctgctcagggagcctcccctgtgggtgtttgctcctccccaggctgtggcccatttccccttcctccttcctgctcagcccaaaggcaggagtcatggaaccccaggaaaggacggaacagaacaggacagggcccccagccccatctttatctcaccggctgctgctggctgccaagcctcccctgaatgggggagggtggtctgtgtgagtcagcggaggcacgaagtggaggaagacgggagcctctgccaggcccgttgatgcgtggcctcagaaatgtatgcgtccagctgtgcgttagggtctccccgtagccgaagtgctctgtaatccatgcgtcgcataagggtcagcgcggcaagcgcatcggttgggaggaatggtggataggagcttggattggacaacccgattgtattccttatacatgcagatctcccactgggcgcagtactgttcatcgagctatngctgaatcagacattctcctagttaaacgcatactgccgaagcacaagtagatgcacgtatactagaacgtgagctttgagtgtgagcagatctgataacaaaaagttgggaaacaggtaaaataataacttggggtagaagttatgcttgtgtttctccaggccaaaatcaacagctgatctggataccatcaagacacctgaaatcttatcatgagccagatgctgaggaagagactccgggaggatcccgaggacggcccagttgcagccatgttgagactgacgctgaggaggaccccaactgtcacgagcaacacctgtcgaacacagccacccacctggggacagatcaagaagctgtcacagatggcagaagaaaacctgaggaaagcgggacaaccagtcacaatgagtaatttcatggtagctatgatagcagttatcaccactgctgtgagtattccttcaacaagggctgacacacagaacaattatacttattgggcatatttatcaaccttggctggcaataatgcctagatgtaatcactctatgacacagttacacatgctttctgatctcagtatttaccataatctgctcctata

SEQ ID NO: 83985 - DNA, 469 bp, Homo sapiens
ggtagtggaaacatttcaccaagagcaaatacgaaggatagaaaaagttaaacaacttaaaaaaaaacgtattcataattttaacagtgaatcaggaaatgtaacctgaaatgtttatgggtttttcaggacatatcatttatttagtagcacttttatttttgtatgttagcttatataacagcttctggaaggaaacaaaacagaattaactctgaacttaagtacagtcagaagttcttcacaaatataaattgctatttttgagtagtataatttatttatttagagatggagtctcactctgtcatccaggctgaaatgcagtggtgccatctcggctcactgcagcctctgcctcctggattcaagcaactctccagcctcagcactttgggaggctggggcgggcggatcacgaggtcaggagatgggagaccagcctggctaacacggtgaaaccccgtct

SEQ ID NO: 83986 - DNA, 385 bp, Homo sapiens
taatctttgtctctatggattcccaagacatttcatagaaatagaatcaaagtatgtggccttttgtgtctgacttctttattgctagtacttttagagtttcattttaacattttacatcatactctttatggaatttactttgatgaaagaagtagagttatacagcttgactctttttttctcccagatagtcctgccatagtctcaacactgttttctgaataattcatctttcctctgatggatcagaaatgtcaccattatcatctactaaattctcagtttatttctggatttcctattttattccattatctatctaaatctttgctagaatcaaactcggttttttttcacttatttacttattttagtgatggag

SEQ ID NO: 83987 - DNA, 726 bp, Homo sapiens
taaatttgaagtcaacttctatcaacttcaggccaggccgtggtcatgtctgtaatcccagcactttgggaggccgaggcaggcggatcacttgaggtcaggagttcaagaccagcctggccaagatggtgaaaccccatctctactaaaaatacaaaaaaattagccaggcgtggtggcaggcgcctgtagaatcccagctactcgggaggctgaggcaggagaattgcttgaacctgggaggtggaggtttcagtgagctgagatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaatttatatggactt

SEQ ID NO: 83988 - DNA, 716 bp, Homo sapiens
taaatttgaagtcaacttctatcaacttcaggccaggccgtggtcatgtctgtaatcccagcactttgggaggccgaggcaggcggatcacttgaggtcaggagttcaagaccagcctggccaagatggtgaaaccccatctctactaaaaatacaaaaaaattagccaggcgtggtggcaggcgcctgtagaatcccagctactcgggaggctgaggcaggagaattgcttgaacctgggaggtggaggtttcagtgagctgagatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatcagacaatgtatgtggatcctctagagacag

SEQ ID NO: 83989 - DNA, 422 bp, Homo sapiens
atttgcccttttgatcttcttttttatgtttttaataattttgaagatttttaaaaatcttttaataaattaatttgaattatataaatatatagaaacaaaatatataaatatataatatgtaaattaaaaattaaatacacttgattgttctaatatctaaagctgttgtgactaattttacttattccatggtggaatattcccttctgttttataatattggttacaaatttcagcagaccagtttttgtagggtttttgtacagattggattgaaagttcattcttccactactctattgcaattgccaatcatctacagagaaatactggttcagaatgactgtattaatttcttcattgattttcgggtaactcgagtagttactaaaaccaaatcaatggagattggggagtag

SEQ ID NO: 83990 - DNA, 349 bp, Homo sapiens
gagaactcaagtatattataacacggtctcacatgaagtacatcagttacagatacaagcaggaaacaaattagcttcaaaataaaaacaaatcaacataaatgaaccttcaaaccgctcggatgactgtttctcccccaaagggaaagatgaaaggagattagaaggaagagaagagaaaaagatgaggaacgagtagggagatgcttaaatccctaacacagcatgtctcacacaaacacagcaggctgccgagggtgtctggggctgtccagcacacagcggacaggcgtttatacccagtcatgcaggatcagctggagaaacgtacagcatgtacttcagggca

SEQ ID NO: 83991 - DNA, 344 bp, Homo sapiens
tgatgcttaattttatgtattttgatatgattaaatgtatgtaaaaacaattttaaagacaaattttcacatcatccataattttaaaatgcctattgtgatcaactttctttgaatccttgacttaatctgtatatcaacatgtattaatcatttatgattttaatatagtttttgtattatatttaatattgcaaacttttgtgttactttataactgcacattttgttggatcagtgtaccaatgtttacattaatcctttattaggatttttttctattttagaggtgttgttattcagtaaatagctttgtacacttggatttttttccctctttaaaa

SEQ ID NO: 83992 - DNA, 280 bp, Homo sapiens
tgcctgctttggcctcccaaagtgctgggattacaggtgtgttgtgaataataaatgagttgatatgtaaaatgcttacaatagtgcctgacacatcatgctgtgtgtgttagcactttttgctggagaagtttttagtggtttaggaacaaggtatatttgattgcttgtacagggttctggtaagtctgaatagagtgggagatccagccaggggccaaagttttcagtgcctcaaagttagctgccagaggcctgcagatgtcagcagcaggaaggg

SEQ ID NO: 83993 - DNA, 557 bp, Homo sapiens
tcactgattcctatcaattttaaaaattaaattagacatcatggcagtgttggtcttaatttgcttattttgtaaagcagtctgttaactacgatggctaagcataactgtattctttcttaaggcctgggaagttattaacaggcaacttgtaaggaaaagagacatttctctatgactcagaaacaaaaaaatgaatcaataaatcaaaagaaaaagggagagagaccattctcatagtgacaggcattagggccattttatgtctccaggagcctaccatatctaaattacagtaactgaagcaccctacaacagaccatgctgcaattcttcattccttcaacaaataattattgtgcactgaaaagtggctacgtaccaagcacctaagtgctggggtgagactgagtccagacaaacttgctccctaatggagctaagggtctaataaggagacaatcaaataaatataaaattccacctataaaaaaatgctataaatgagaggtgcacagtatcctcagagtgaaacataaggatcagacctagttaga

SEQ ID NO: 83994 - DNA, 105 bp, Homo sapiens
tgctgggattacaggcatgagccaccaagccaggccccaaggtcacctttcaaggtcaatgagctggggacagccttcccaccctctcctctctttggctctccc

SEQ ID NO: 83995 - DNA, 763 bp, Homo sapiens
ctgttggcatgtttgtatgtgtaactagggaaggcatacttaaggataatacttagacttgatagaatttttttctgacttcactgcacttagtcaataaagttttgtgaattctatcacattatgactgaatctctcctttttttttcgtccccctttgttacagttcaaggatttctttgattaattaagataattcccctgatttccatatgttcgtttctttcttcctttagtccatcttttctatatagttgccctgtggtgatttttctaaaacacgcatctcctcatgtgcctttcagtggctctgtatttcctctattctgtttgataaaccttttcttgctttagctttccagaaaactcctacacagcttccaagatcccatgtaaatatttcctcttctatgaagcctttcctaacctttctggacatacagttaagttgaatcatccgctatgatcccataaaattttgtatatgctttaaacatggattttaacacatcttaccctttgtgtttcagattttccttatgaatgttaactcctcacacttagagagcaggtcttattcctctctagattctttattctagcacagtgtttggcacagagtagtgcttgttgaggaaacaaatggctcaataaatgagtatatgaatatatgtgtatatattaattcatccatcacaggaaattttaaaaatgtacactcattaaagtttatgtgaccagcaatagaattattatagatata

SEQ ID NO: 83996 - DNA, 384 bp, Homo sapiens
cagctttggaaagactttgacctctgaacaaaaagccagaaggctgcttaaagaaatagtaagggtttcacttgccctggatagtcacaaatctaggagtactggttcactgccttgggttaccaggtatcagctctttcacaatctctcctcttcccatgcttccccttaaagtccagttgacaaatgaaaaagaaaaaaaggccttgatttatagtattgccaaacaacctcataagaatgggtaaaattacatacacacatacatagagaaggagataatgctgtgaatctactgagctggaatgcatgctccctaggaacacgtgcccaacctgtaattttatttctaacttttataaatatactcctttttcacgtatg

SEQ ID NO: 83997 - DNA, 706 bp, Homo sapiens
  misc_feature (698)..(701): n is a, c, g, or t
  misc_feature (703)..(703): n is a, c, g, or t
  misc_feature (705)..(706): n is a, c, g, or t
gctataaaattctgagactaaatatcaaattaaagaaagtactaattgtcagcgatgggggatgtactgctatttgcttctagtggtactcactgctcatttcctatattcactggtataaaaaaatttcaaacaccctcaaaaaagcatatactggtggtaccaggaaaacgctgaaaatcattactttctgtgtggtgtccagctcttttggttacatcatcacttcgaccattcacttttaaagaaaaacttttgtggaacaaaaatataaagatttattttttttcttggtggcttagcacagtggcctaatgtggctgaccatgtgcacctgttgtgtgagtcacttagacgtgctttgtttcttggtcacagttgatccctcaactcaagcatctcaccctcaaaatgtttgtttgggacccaagaggcaaaccttgagatgggttatttctttcaccttggattggctcatctgctgggagtggagccaagctgacatttcctttcctttttgtctgcctatcactacgtagaggcagcacataagagagggaaagccatgcgcgtggagtccagcacatcacccagaaggcagatgttctatctccattttactcattaaaacaaacaaaaccacacctggattgcctggtacttaaataaaatgcactatgatgattgaagaaaaatannnnanann

SEQ ID NO: 83998 - DNA, 103 bp, Homo sapiens
gaggagtttccctgctcaagctctctgcctgttgccatccccgtaagatgtgacttgcctctccttgacttccgcaatgattttgaagcctccccagcaatgt

SEQ ID NO: 83999 - DNA, 829 bp, Homo sapiens
accttgattctgaaccgctctcagctgctactccatttctctgttcctcttcatatcaaaattcctcaaaaagaggagttgatcccaactggttccacttcctcagtccattcattcttaaacccattttaatcagatttctatcctctccactccactaaaggtcagcaagcctcctcaatggcaataccagtgggcaattcccagacctcatctgaacctctcagcagcatctgacacaattgatcacctcctccttcctgaaactctttcttcactttgactccaaataccacactcccgtagttttcctcctacttcactggctctgcctcctcagaatcctttgctggacactcttcccttcccaacctataaagacatgtgtcccagggatggggaccttgggcctcttgccatctctgcctacactccctctttaggtgactcctatcctaacctcttccttaagtaccgtcagtaaactgagggttcccaattttgtatttccaggtcctacctttccctcatcctcagactcacatatccaaatacttatgtgacaaatcctttaggatacataataggaatcttaaacttaagctgtacaaaacggctgaggtgggcggatcacttgaggccaggagtttgacagaagcctggccaaaatacaaaaattaaccaggcatggtggtgcatgcctgtaatcccagctactcgggaggctgaggcacaagaatcacttgaacccgggaggcggaggttgcagtgagctgaggttgtgccattgcaatccagcctgggcaacagagccagtctctgtctcaaa

SEQ ID NO: 84000 - DNA, 818 bp, Homo sapiens
gccctgaagcccatttgtcatctaaatggtccgtccccttcttaaacatcattttggcccaaggtccattcatggggcctgccgggtgttcctgggaagatgggcagaaaatcccaaggccaccatttagtgccaataaacagaaggcctggtttcttcaaaagaaacacaagaaattgtttcctggttttgccacagagattgggtcacagagtgccacctaaatggtattaccatatttgtgttgtcgcctcttggtttgaaatttattcctggtatgacttgtgtctccccttgttccatctctgacacccaagcccatgggatgacaacccaggctgagatgtcccatgtgtcacaaaggagtccttcagtatttccaggaatagttggaaccagcactccatcccctacctggacctggcaccctctctactcttgtcaattctacactaatcacaggaagaaggtggaattagtccaagctgggttttcagaaataacttgtagacatgcaacagatgtttataaccctcagaagcggaaggaaacttggaaaccctctctttcggtgactttttttctaatgattgtctctgccatgaaattctaacttcaaatgaaatctttggcaggaacccagggctgttctgtcaaggttcagctgcaggaccagagccccttccacctaacccccactcctatcctgatgcttcctgaggcacatctgctgtggtttctcaccagagaacagtctgcaaaatcactgcaccttgtccaactccattttccaactgagaagacttggcccagagaag

SEQ ID NO: 84001 - DNA, 313 bp, Homo sapiens
ctgcactccagcctgggcaaaagagcaagactccatctcaaaaacaaaaacaaacaaaaagaaatgagagttgaacgatttccaggggttcctggcagtatcatggcctaggccctgtgcctccaacagcccggggaggagctcctctgcacacagctggatgagcatgaagcagggggagagagcaacaacccaccctaccaccccctccttggttgttttgaacctcaaagagacagccagcagtagatggtgaccagcagaacctcgcaggcgcacgacgggttcatccacccatttccatgacattttt

SEQ ID NO: 84002 - DNA, 879 bp, Homo sapiens
cgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttacccatgatgatggctctttcttgcctctgccaccagcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattgggggtcacgggtgtttgccgtggggaagtacactcatttcatccagtccttccttggagtcagccgaggagttcttcatgcgtgggtaccgggtgcactactacatcttcactgacaacctgcagacgttccggggtccgctgggtcccacgggttctcagtcatccccatcaggtcactcccacgggaagagaatccatgggcgatggaaacatagcagaatggtagaaggtcacggaaggtg

SEQ ID NO: 84003 - DNA, 273 bp, Homo sapiens
agaatacataaacttcaggaggaagagttgtcttggtccagtatcaacaggatgtgggccagtgcttcagtggagtgggaaatgtcaggaataagccaaaaacatgggtccagataaataaatagatctggaaagacaatacaacatggtatgaacagtggtggacttgggaatgtttgcagtttgcattcttttgttacattttgctaagagaaacatttattactttcatagtaaagaacttaaaacccaatgtaaattatacttaaaaaa

SEQ ID NO: 84004 - DNA, 184 bp, Homo sapiens
gcggccgcctactactactactgctcgaattcaagcttctaacgatgtacggggacatggtatgaacagtggtggacttgggaatgtttgcagtttgcattcttttgttacattttgctaagagaaacatttattactttcatagtaaagaacttaaaacccaatgtaaattatacttaaaaaa

SEQ ID NO: 84005 - DNA, 527 bp, Homo sapiens
gtgacatcccattgaagtccaggttcctagtgtgtctttgccactttgggctctgtttgagcactgtggctagtaatgcctggtgaaatgtaattttggggaaatgtgggtcattcagtgactttgctgagacagagttcacctatcacaggactaagctccatgtacgcaggaatttgttgaccaatgaatcctagagcactggaataatgactagtgcctagtagacatccgataaatattattgagtgaatgaattgttgacaacttaaaacataccactgtacatattataaagatatgtgggttctttttcctgttgggttttaatcaaattgctggcgtttattagcagcaaaaattggggttctgcatttgcactgttcagatttatagattaagcaggatgggcattccagaggtttctgtcttctagagttatgtctcagaaaccagaagctggatgtgcaatcgttttttactacattacccaggcaagaattaattcatcatttttatttcaccat

SEQ ID NO: 84006 - DNA, 431 bp, Homo sapiens
tgaggagagagaaggataccatcagtgacgctaaatttcccttcatgtcttattaaataaaagtatctttcatgaacttccatatctgaggttcttaatagtagtgtattcttaaatatctattatttatttatttttgagacagaattgctcattgagtcctatgtgcttggcatgtattaaggccttccaatacctcttaagatatgtagggttttgtttgtttgagacaaggatgtgcgctgtcacctaggctggattgcagtggcacaatcaaggctccctgcagcccagacctcctcagtctcaagtgatcctcccacctcagcctcctgagtagctgggaccacaggtctgcaccatcacacccagctaatttttatttttttgtagagatggggtcccactatattgcccaggctggtctcgaa

SEQ ID NO: 84007 - DNA, 835 bp, Homo sapiens
gcatgggaaaaggaggaaaaaagtaaggtctatgacatttggaaagtgaaatgtaagataaacatggtgatcagagcataggaagcttataactaactgaagaagaaaggtcctgcaagaaataaacaacgttttacctctgggccctggaattggaggcaacaaaaatcactgaaacaaggaagaagagagaaggctgaaattctgcagcagcaattcatctttcagatttcctccacagccaaatgacaactcctcctaaatcctgatataaggcaggagacttacctattggtaaaattaaatcagaaatattctagacttcaggatatcagacacaatagagggcctgaaaacaagataattgatgaaaaatctagataccaagtagagaagccatcaactccttctttacccaggatgctatattccaagatttagctctctaggcaggagcataatagattcctatttcaaggaagaggtgtgtatatgggaatgaggggtatagaattaatttctagatattgacatttgaagcttgttgaaaacattcaggctctacccaattattctaagacctgtgaacaagtaaactctacttagtaacacaaacctcactctctactttttaagcctcactttaacatatagattgctaagtatcccagggaatttgagaaattcctttaatgtaagacaaaggaaaatgggaaaatcaggaataataactcagaagaaattgaaacattcacaatacagttagcaaaagaaaaactttttaaaaagcaataactgatatgctcagaggaaaaataaaagacacaggaaagat

SEQ ID NO: 84008 - DNA, 937 bp, Homo sapiens
caaaactggaaactcactcagaggcccatcagtaattcagtgactcaccggagtttggaacatccaaagggtattatatgattccatgtaacaatttacactggtgatgtctgagctgccgagtaaaagctatgaggcccattgaggaggattgtgaatccatcctgagcttcgaaaacgatttcatacatatatatatgttgagaaaaatttagagacagacatgatcacactgcagctcgccaacatcgcaaaaccccatctctacaaaaatcagctaggcgtggtagcacttgtagtcccagctactcgggaggttgaggagggaggatcccttgagccccagaggtcaaggctgcagtgagtcatgattgcaccactgcactccagccttgagacggtatctaaaaaagattctctacacggttgcttgtgacataccagtactccctggccacgcttccatttctccattagtttccaaaatatgtgctaccccagtccagtccccttatgtgcacttttaaatggcatagtttctactagaaatacaagtgaaactatcactggccgtaagtaattgtaaaatgacaaaagcaaagctgttcgattctaataagctgcagtggctgctggaggtgagtcccaggcccacccagagcagggcagggcccccgggccagggtgagccccaggccagggtagaggtggcatagacagcggttatggggacagacatgtagcacagctggcgctaccgccacgtgtagtaactagatgccaggagcgggtacagctgggcctggcccataccagggtaggttcacggccgtatcacgcccttggccctgctggcagctgaggtcggcagagtctggggctctcccttcactcctcctccctcctctccccgctgtgtgtcccgcagacttgcctc

SEQ ID NO: 84009 - DNA, 667 bp, Homo sapiens
ttattttttgtgatggagtctcgctctgtcacccaggctggagtgcaatggtgccatcttggttcgccgcaacctctgcctcccaggggcccagaccccctcccagcctcggggctgaagatctccaggcctctcaaagccaagagctctgcgaggggctcctcctcaactccctccgggacctggatctgtctggtgtgacggatgaaggtggctctgagagaccgggccctgggtgcccgcgggggcggctgacactgtcccgaggaggcgccagcaccctctcgtctccccaccagctcctcctggtgcccctcccaagccccggggaacttcccaggttggcctgaggggggtcctggagagctgcaagcaagggggaggggagcccacaggcctgcagcccatggtgagtttcacacctgaagccagccaggtggggtgtgctgagccgaggggtccctgtccccattctgtggggttccccagcacggggctccatggttgaggctctctgggggtggccagaatttgtggagacctctcggggactcgcagataccacccggaggcagtgggatggaggagtgattggctgacccccgccctccaaggggcccccatgggacaaggtgctataaacgccgccccctgcactggggacacc

SEQ ID NO: 84010 - DNA, 2599 bp, Homo sapiens
aaagctaaatagccatacagcagctctgacaatgttgtgctggatattgcagtttgctttcaaggtgcagatgtaaggatttaaaaaaataataatttggcaccaaataaatatgagtagcattcattgaatctgcggatttcatgacgtctctctgcgtggtccaccacttttctcctaaccggggatttttttttttcttctgccactcttatctttccccacttcattccacccagtctccctcccccgtccctgcccaaacgcgcgcccctccgcccctcccttggccccagcgcccagccctgctctccgcgctcggccagagggagccagtccggagacggccgcacctggctggagaggctgggcgggcggaggggtggagacccgcggacgccgggaagccggacctggagccggagcagccgcgagcagaatggagtctcctaacagcctctcggtgctgatgtgaaatttgaccatctgattccagtttttttcttttccttttcttttttgcatttccttccctcgccatccgtcgtgtagtgaattgttcagtcttgctccgtttcaagagaggagatcatgattgagtgaagccaccccgtccgcagccaggaaaagcacaaagaagaaactgcaacaatggccaagctgacagaatccatgactaacgtcctggagggcgactccatggatcaggacgtcgaaagcccagtggccattcaccagccaaagttgcctaagcaggccagggatgacctgccaagacacatcagccgagatcggaccaaaaggaaaatccagaggtacgtgaggaaagacggaaagtgcaatgttcatcacggcaacgtgagggagacctatcgctacctgaccgatatcttcaccacattagtggacctgaagtggagattcaacctattgatttttgtcatggtttacacagtgacctggctcttttttggaatgatctggtggttgatcgcatacatacggggagacatggaccacatagaggacccctcctggactccttgtgttaccaacctcaacgggttcgtctctgcttttttattctcaatagagacagaaaccaccattggttatggctaccgggtcatcacagataaatgcccggagggaattattcttctcttaatccaatctgtgttggggtccattgtcaatgcattcatggtgggatgcatgtttgtaaaaatctctcaacccaagaagagggcagagaccctggtcttttccacccatgcagtgatctccatgcgggatgggaaactgtgcctgatgttccgggtaggggaccttaggaattcccacattgtggaggcttccatcagagccaagttgatcaaatccaaacagacctcggagggggagttcatcccgttgaaccagacggatatcaacgtagggtattacacgggggatgaccgtctgtttctggtgtcaccgctgatcattagccatgaaattaaccaacagagtcctttctgggagatctccaaagcccagctgcccaaagaggaactggaaattgtggtcatcctagaaggaatggtggaagccacagggatgacatgccaagctcgaagctcctacatcaccagtgagatcctgtggggttaccggttcacacctgtcctgaccctggaggatgggttctacgaagttgactacaacagcttccatgagacctatgagaccagcaccccatcccttagtgccaaagagctggccgagttagccagcagggcagagctgcccctgagttggtctgtatccagcaaactcaaccaacatgcagaactggagactgaagaggaagaaaagaacctcgaagagcaaacagaaagaaatggtgatgtggcaaacctggagaatgaatccaaagtttagtgccctagctgggcaaacccttctcttctccccccaacacaatctttccttgtctctcattctctttctttttctgtctctcttgctttgttctttatttgtttatatttaatttttacatgaccagaaaacaaatcttcaaggtgtaaaatatctacctgccctctctcagttattcagattgacaaggtagacatggatttgatgaaagtgcaaagtgccctcatttgtggcccaagcctggtctcctcccaaaatactacacatccaactcctggagatttcagttacttacctgcatgtgttgtacaataccagatcactcaaaaaggtgtgtcaaagattttacctgggatatgacaagcaaggtttctggtgcctatttattcattcagtgagacacagagtggagccctcagttttatggatcccaattcatttcatctactacagggtgaggtgcttgcccccatgtgggtgtggcagttacagggcccaggtgagctgaagacaaaccactgtacatatatatgccttatgtaattattttctttttgtaattagtaataaaacccagcatgtacaaaagtaccatagaacagaactgctaaatactgtacatagatgtatcattaatgtaggtttagatatataactttagaaataagaagcaaaa

SEQ ID NO: 84011 - DNA, 2537 bp, Homo sapiens
ccacttctgagccacccgctgcccctccgcactgctggcaaacccagttcctgcctcagccaggtctccttccctggtttccagtcacacagagcccagcagctttctctttcagtcccataagggcagccttgtgtccctggccactcttatctttccccacttcattccacccagtctccctcccccgtccctgcccaaacgcgcgcccctccgcccctcccttggccccagcgcccagccctgctctccgcgctcggccagagggagccagtccggagacggccgcacctggctggagaggctgggcgggcggaggggtggagacccgcggacgccgggaagccggacctggagccggagcagccgcgagcagaatggagtctcctaacagcctctcggtgctgatgtgaaatttgaccatctgattccagtttttttcttttccttttcttttttgcatttccttccctcgccatccgtcgtgtagtgaattgttcagtcttgctccgtttcaagagaggagatcatgattgagtgaagccaccccgtccgcagccaggaaaagcacaaagaagaaactgcaacaatggccaagctgacagaatccatgactaacgtcctggagggcgactccatggatcaggacgtcgaaagcccagtggccattcaccagccaaagttgcctaagcaggccagggatgacctgccaagacacatcagccgagatcggaccaaaaggaaaatccagaggtacgtgaggaaagacggaaagtgcaatgttcatcacggcaacgtgagggagacctatcgctacctgaccgatatcttcaccacattagtggacctgaagtggagattcaacctattgatttttgtcatggtttacacagtgacctggctcttttttggaatgatctggtggttgatcgcatacatacggggagacatggaccacatagaggacccctcctggactccttgtgttaccaacctcaacgggttcgtctctgcttttttattctcaatagagacagaaaccaccattggttatggctaccgggtcatcacagataaatgcccggagggaattattcttctcttaatccaatctgtgttggggtccattgtcaatgcattcatggtgggatgcatgtttgtaaaaatctctcaacccaagaagagggcagagaccctggtcttttccacccatgcagtgatctccatgcgggatgggaaactgtgcctgatgttccgggtaggggaccttaggaattcccacattgtggaggcttccatcagagccaagttgatcaaatccaaacagacctcggagggggagttcatcccgttgaaccagacggatatcaacgtagggtattacacgggggatgaccgtctgtttctggtgtcaccgctgatcattagccatgaaattaaccaacagagtcctttctgggagatctccaaagcccagctgcccaaagaggaactggaaattgtggtcatcctagaaggaatggtggaagccacagggatgacatgccaagctcgaagctcctacatcaccagtgagatcctgtggggttaccggttcacacctgtcctgaccctggaggatgggttctacgaagttgactacaacagcttccatgagacctatgagaccagcaccccatcccttagtgccaaagagctggccgagttagccagcagggcagagctgcccctgagttggtctgtatccagcaaactcaaccaacatgcagaactggagactgaagaggaagaaaagaacctcgaagagcaaacagaaagaaatggtgatgtggcaaacctggagaatgaatccaaagtttagtgccctagctgggcaaacccttctcttctccccccaacacaatctttccttgtctctcattctctttctttttctgtctctcttgctttgttctttatttgtttatatttaatttttacatgaccagaaaacaaatcttcaaggtgtaaaatatctacctgccctctctcagttattcagattgacaaggtagacatggatttgatgaaagtgcaaagtgccctcatttgtggcccaagcctggtctcctcccaaaatactacacatccaactcctggagatttcagttacttacctgcatgtgttgtacaataccagatcactcaaaaaggtgtgtcaaagattttacctgggatatgacaagcaaggtttctggtgcctatttattcattcagtgagacacagagtggagccctcagttttatggatcccaattcatttcatctactacagggtgaggtgcttgcccccatgtgggtgtggcagttacagggcccaggtgagctgaagacaaaccactgtacatatatatgccttatgtaattattttctttttgtaattagtaataaaacccagcatgtacaaaagtaccatagaacagaactgctaaatactgtacatagatgtatcattaatgtaggtttagatatataactttagaaataagaagcaaaa

SEQ ID NO: 84012 - DNA, 764 bp, Homo sapiens
  misc_feature (696)..(696): n is a, c, g, or t
  misc_feature (699)..(699): n is a, c, g, or t
  misc_feature (734)..(734): n is a, c, g, or t
ccacttctgagccacccgctgcccctccgcactgctggcaaacccagttcctgcctcagccaggtctccttccctggtttccagtcacacagagcccagcagctttctctttcagtcccataagggcagccttgtgtccctggccactcttatctttccccacttcattccacccagtctccctcccccgtccctgcccaaacgcgcgcccctccgcccctcccttggccccagcgcccagccctgctctccgcgctcggccagagggagccagtccggagacggccgcacctggctggagaggctgggcgggcggaggggtggagacccgcggacgccgggaagccggacctggagccggagcagccgcgagcagaatggagtctcctaacagcctctcggtgctgatgtgaaatttgaccatctgattccagtttttttcttttccttttcttttttgcatttccttccctcgccatccgtcgtgtagtgaattgttcagtcttgctccgtttcaagagaggagatcatgattgagtgaagccaccccgtccgcagccaggtaagcggtgcgctgagctgctcgcaggcgaggagctggcgtccacctgggcgaggcgttccgtgctctcgggtccccgcgtccccttccccagctccgccgtcgccgcaggcatctccactctcatgagaaancanttttgatgtctcacagagggtcagtcctcagatanatggtcggacttcctccggggataaatgtc

SEQ ID NO: 84013 - DNA, 1735 bp, Homo sapiens
ttgggggttagagagaagcgagctgctgtctgaccagcagcttgggattggtggaaggaagcaggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgagcagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccaccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaaaaaaa

SEQ ID NO: 84014 - DNA, 379 bp, Homo sapiens
cggatgtgatgccactgacttgcgcactgggggttagagacaagcgagcttctgcgtctgactcgcagcttgagactggcggagggaagcccgcccaggctctataaggagacaaggtgagatgctgagggaggactcaggaggacccccaccccacatagacgaccacaaaaaatccaacaccacccctgctgccagccctgggccactcctggagacttctcagtctgtggtgggggggccaccaccccactgccacttaagcctcaggggattctgaagtcagagcttggggtgatcagtgcaagactggtgggggcaggctctgccaggcatcaacctcaggaccctaaaagccagctgagcgtaccacaccgct

SEQ ID NO: 84015 - DNA, 1849 bp, Homo sapiens
agggaagcaggcgcaggctctgtgaggaggcaaggcaggatccccggttccgcccccgctttcaaccaaggaaagccccagctgcccggatgtgatgccactgacttgcgcactgggggttagagacaagcgagctgctctgtctgaccagcagcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgagcagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccaccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaaaaaaa

SEQ ID NO: 84016 - DNA, 1782 bp, Homo sapiens
aacccaagaaagtcccaggtgcccggatgtgatgccactgacttgcgcattgggggttagagagaagcgagctgctctgaccagccgcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgagcagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccaccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaaaaaaa

SEQ ID NO: 84017 - DNA, 409 bp, Homo sapiens
aagaagttaggaagtattccctccttcagtttttcggaagagtgtgagaaggcttggcagtaattctttaaatgttcggtaacatgccctaatgttaccatctgcatgtttctttgttgggagatttttgattactgattcactctctataacagactagttgtatgtctgttcagattttctgtttcttcacgattcagtcttggtaggttgtatgtttctaggaatttatccatttcttctatgttatctaatttgttggcatatgatttttcatagtagtctgttataattatttttaatttaatttttctgtttttttcttactctagataaaggttgatgaacttggttgatctttaaaaaaaacactcagtattgttgatttttttcctattatttctgtata

SEQ ID NO: 84018 - DNA, 396 bp, Homo sapiens
cgctgatacatgaaatcaattttcagtcattgatgttcatgcaaatttaggttggaaacgctagtttttctctgtggagagttttctataagttttcctaatagcttgtacgtatgacttcaactaactgttagttttgaacttcttacataaggtattttgaaatgatctgagaaaatctagttaaactcttcaaatacagactttgaaatatacatgaaaacttcagcagccccatttgtggctttttcattcttgtctcttaggttattttattaaaaaaaagatttctgatttgtagctagaacatggttgatgcccaacaaatactgattgaataagtcatattttcacataaatctcaggtcatggggattaataaactcgctattaatt

SEQ ID NO: 84019 - DNA, 406 bp, Homo sapiens
ggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggc

SEQ ID NO: 84020 - DNA, 350 bp, Homo sapiens
cgcagtcctcagccgcccgcgccctcggcccggggcgcccggctgcgggcccgaagcgaggggctggcggagctgcgaccaatggggcggcggccgagcggcgggccccgccccgtcccgtccggccccgccccgcccgcagctcccgggagtctttctctccatacgatgatcaatatttctaatgaatagttaggtatcaggccggttgtctaaggttccatgctccgtttctcctattgtcgccgcggcggcaggcgcggggccgcgccgcgaggcctgatccctgcagcgcgggcaggcggcgtcgcagagcggagctagctggatgcgtccggactcctgcaggt

SEQ ID NO: 84021 - DNA, 606 bp, Homo sapiens
tgctggcagaagggcctcaggtggaatgctgggcatgggtttgccccacagcagtctgattcaaaagcacctgagagatgggaggagtactagggttactaaacacaagaaggtgtttcaggagaaacacatcaaaccatttgtttttgacccttaatacttaacatgaatgatgagttgcagaacagtcagtctttccaagatgtattgttctatcctcaatagctgcagcctctccaagccagtgggctggtgacatccaggatgatcctcttccttgcctggaggtgggatctagtgccacagcttgttcggggaagctggcatagaagatgatttgctcaacaaagtcaccgctaaactatcgcttaggtctagtccccggcctatggcaccaagtactcctggtagtacttgtacacagaatttctctataataaccagaacatgtcatccatggtaatgtctgctacatatccaaccacagcatcaaattctgtctgatgaagggcaccagccccttcatctttatcatgcctaatattgtgaaggccatgtgctaaatccagcaatccgctccagtaggtgtccttcaggatacttttc

SEQ ID NO: 84022 - DNA, 542 bp, Homo sapiens
agccccacatttctagcccaattcgcattgggatgcggggtcccagagccgccgtgcaagagctctcagagatgaatcaagcagtgcccaggctgcactgctgcttgtgcaaagccaccagtggccttgctgtatcttcctcagtccttgcttttctccccccttacccagctttgttcactaattagcagttctctaggggattcagtaggcgagggatcagaatcccttgggataccttgacaagttcccattatgaccccaggaatctccccctttgccccattttgaaaactgctgtccaaccacctcatggccttgtactctgcctactactcaagactacatctggttcctgggcctgtgctctgggctgcagctgttcctttggcatatttagtggttccaggtaacccagagtccctagtgaatgggcctcatctaagaattttaaaccagtagaaataaagataaaatacacatatatgactgtaaatataagtgcatatttaaggttttcaaaaatgtacactctattctta

SEQ ID NO: 84023 - DNA, 771 bp, Homo sapiens
cggacgcgtgggtcgacccacgcgtcctggccaacatggtgaaacccccgtctctactaaaaatacaaaaattagccgggcatgttagtgggtgcttgtactcccggctactcgggagcctgaggcaggagaatcgcttgaacccaggagccagaagttagcagtgagccaagattagcaccattgcactgccagcctgggtgacaggagtgaaactccatctcaaaaaacaaaacaaaacaaaaaaacacggctcttgggcaggtaggccaatatctttgaatagcatggaattgtccacccagatttcctgtccttgtctttctgtccccatccacagagtagaccagcactccttctctgtgacatcaccccagggagacagcccattctcatccatctccaccatagcctgtctgtatcaggtggagaatgtattagaaaaacacaatttacaatactgtagataccatttatgcaaaaaagtgtgcacaaaatgactaaggatatatatatatatttgtgtatgaagaagtgcttgctgttttgttttgttttttattttcaagcctgaaagatgacacataggtctcaaaactgtaacttctgcttgaaatctggggtgccagagctgcaaaagcactttggcacgtgctgcagtatcggaaactagtgagctaaatccttgaagcaggttctgtttagactgaaacgggcgaagctgatcatgtttctgaataagcaagacgtgttgtgttcatttaaaccact

SEQ ID NO: 84024 - DNA, 303 bp, Homo sapiens
tttagcatttcttgcaagatgggtctgaggatggtgaattctctcagcttttgtatatctgggaaagactttaaccctccctcatatttgaatgacagttttgctggatacggtattcttggatggcaatgttcttcatttagcactttgaaaatgtcactctactccctcctggcctgtatggtttccactgagatgtctgttgccagatgaactggaactcctttatatgttatttgcttcttatctctcactgcttttaggatcttctctttctccttcacctttgagagtctgattatt

SEQ ID NO: 84025 - DNA, 944 bp, Homo sapiens
gccgctcatgatgctcagagattttgtgtgccggggactgagagggtgcagtgggcattgcctttctgcccctgatgtctgtggcgggtgtcacatggaatgatgagggctcactcacatttctggcgagtggtgctggctgccagaagctctactcctctccatgggtaacttctcacagcatggtggcaggactgtccctcctcagcctctgaagtcaggcagcatcatttctgttcaccaaggcagcaggtgcagggacataggtgagcagaaagcatttagacacgtgtccagggtcttgacaacaggctggagtttggaagaagtccggataagcagctacagtgccctctgtcttcctcatccctggacacatcccgcccagcccagaactgagagcattaactcagctcctccgatggaagactccctcgtacagcctcagagtctcaggtttcccaggtgccctatagattctcccagagtcccaagggcagtgggaaagcctgctcctctctcccaggggccttgcccagactgcagtcttgctgccagaggcctaatagctggtgttctgggtgtaccactgtggtgcagtttgtctcacccccaaccccctgatggtttgggtctctacagctttccacttcccactgggttgggccctagtcctgactccagaagtgaagtgacttttgttccagaaggtgcggtattcacagtctcccctgggcctttgcacatgctgttgttcttctgcctggaatgttcttcctacttgcccacattgcatgtaaaaccctatcttggcttagatattacttcctcaaggaagctttctcagacctctccctgccaaggtgggcacacagtacctgacttgcccctgcggtatcagatctcactgaactgtaattgtatttactttgtgttttcctccc

SEQ ID NO: 84026 - DNA, 714 bp, Homo sapiens
ttgacattttaggaagcatcccccttgagaactggaacaagacaaggatgcccactcttcccactcctgttgaacacagtaccggaagtgcaagccagagcaatcaggcaagagaaagaaagaaaaggcatccaaataggaaaagaagaagtcaaactatctctcctaggaatccctaaagactgccaaagacttttggaactgaaaaatgacttcagtaaagtgtcaggatacaaaatcaatgtacaaaaatcagtaccatatctttacaccaataatgttcaagctgagagccaaatgaagaacatagcctaatttacagtacacacacacatacacacacaccccttggtttcacctctaaccaaggaagtaaaaggtctctacaaagaaaactacaaaacgctgctgaaataaatcatagatgacagaaacaaatggaaaaacattccatgatcatggattggaagaataataaaatggtcaaactccccaaagcaatctacagattcaatgctatttctatgaagctaccaatggcatttttcacagaatcagaaaaaactattctaaaattcatatggaagtaataaagtaataaagagcccaaataggcaaagtaatcccaagaaaaaagaacaaagccagaagcatcacattacctggcttcaaactatattgtaaggctacagtaagcaaaacagcatggtactg

SEQ ID NO: 84027 - DNA, 526 bp, Homo sapiens
ggccccctgggtcctcttataaagcacggttccggtgggctttccggcctcacgtaatgtctccatcccacaggccaaattcccccagcctcattattccctcttctacatgttccggggcaactaagtcaggtctagcttgtgagataccggcatcattttttcccagtctacatggatcaccccagcagtgggtttgccccatgccctggggtctttgaaaaacccatgtgatacggttggctgtgtccccaaccaaatctcgtcttgaatttccacgtgttgtgggagggaccaggagggaagcaattaaatcatgggggcaggtctttcccatgctgttctcatgatagtgaataagtctcatgagatctgatggttttaaaaggagaaatccctttcgcttggttctcattcttctcttatctgctgccacgtgagacatggctttcaccttctgccgtgattctgaggcctccctagccacatggaactgtgagtccattaaacctcttttggtaaattg

SEQ ID NO: 84028 - DNA, 545 bp, Homo sapiens
acttggaaaccatgcaagtattttatatcattaagaaacaaaattaaatcaaaatagaaaaaaaatctctaaatattgaaaagaaacccaattatatatcgagttagtggtacaatcatatagaaagtaattacttcaaataaattatttggaagtattttgactgtacaaatatcctagaatgatacaaatatctttttaaaatgtgacccatctatccacataaaggaatatatacagccataaaaaggaagctctgatacatacaacacggatgagccttgaaaacatgctaggtgaatgaaacaagcagcgatatgaggccacatattgtatgattccatttaatgaaagggagtggagagagaatgggctacctgcaaagaggcaggggctggaggaaagttttatagggtcctgctgaagggtgctacgtgtggaatgaggtcattgtgcccgcaggttgtttgtgattagctgtctctaacaattgttcatacagtaattgttcattatggttctcaactgggggctctccccaacct

SEQ ID NO: 84029 - DNA, 480 bp, Homo sapiens
tcccagccttcaagttccctgcagggttggttgaggccttgtgactgcagctcagcccactcctctctgccatcctgcttctctccctttccccatgcaggtgtcaattctacaaacactctctgataaatgctcacctctgtctcagaagctgattcctggggaacccaatctgtgatgatttctaatagaaggagattccatttcttattggtctataaatgaaagataggaacctcatcccctcatctagtcatgtatgatgggttgtgattatctagatgtattactcaatgatgagcctctcccaccctctgctcctaactggccatggggcactggcagccatttaacttctttgctcctcagtttcatcttctgtaaagtaaggaacaatttaatcaaacgggatattccagatttttttcaaattttgtgatgaaattcattagaaatattaaaagtatctaaaaaccaaaa

SEQ ID NO: 84030 - DNA, 1511 bp, Homo sapiens
cagacttgtgtcataattataatgatatcgttcctgccgttttcttttgaaatactgatttcctcccaccatttttttgtctccagttatggccaaagccttttgttttgaattctatgttcaatagtaagttgcagtttatttgcaatttgagcacttgcatgttttctgatgtatcacttgctccccttttaactgcatggttaattgtgaatttaaagtagcgcagagcagcagttaactatgattggctgtttttgataaaatgtattgctcagaattttttaatctattagaaagaacagaccaaaatcaataggatttgcagtgtgtcattatattaaggacaaaattgtaaaagtgtctttgaaaatgatcttggggaaattgttaattttgtagattttgaaatgtagtttttacacagctatttgtggcttttaagggaggaggtgtgattaccttagtatattctttaaaagtaaagaacatgcacaataattttggcaacaccagggctttaagaaaacaacattcgtgaggacattttaggttagaatatacattttagaattggaaggaatcattatgtttacactcctacacttttcaaatgaaaagaaacaaacttggatttctgaaaaaggaagtgacttttcctttttgcctaacattacacagaggactagtggctttttccagtacctccctgctattcaagaaatttgaaatatcaaggacagtaaagtaacctacctgaagttttcagatgctactactactatgactgtattaaccaaatgtctgtccgcacccatctgccttgtcatcagtgaaacatcttacaaattgtcaaacaaaatatgggtagagcttagttatccaagaaatagaaatcatgttattcctgttagatattggcataaggaaatagatacaaacatgttcttgcttgttaggtttctgctttttctttgaattgttgcttaaggggtgttaattgcaaaccagactacaaacaaaaacagtttatgttaatttcagagaaatgtctgtgtgtgtgtgcgcgtgtgtgtgtgtgtatggcaaaaaacagtcccaaaattatatgtatgtaaactttaaaggtgaaaattaaatttaataccctgctttttaaaattctaagcacttcaaaactaaaaatactggatttttatgcttacaagataatgggactttttttctttgattgttaaactagtatggcactttcagcagagaagtaagctgcccagaacagtcttggacatatagtaaatactatataggtgttagttgctggggtagttctttctttaaaaaaaaaaaagaagttatgtttttcaaatattactaagtttaggcctacaagacattccaaaataatggaaaaattcaatcctgcctctttggaaacattttggaaataagccccaaacactggaagccagtcaattctttttttgcaattctttctgaaatctttcttt

SEQ ID NO: 84031 - DNA, 399 bp, Homo sapiens
aaatataaatgaggacattctgttgcattgtgaacctgtgagatttggggcatgtcggatggttttctaaatgatacagacttattttaggcaaccaagagaagctttggattaaaatttgtattttaacctgcttaaatttgaaactacagaagataaagttatataaaaaaattcaaagttttatatttattcctaatgcccgtctataattttacctatgtatagagatgttagagaatttagaaacttaacgcaggattggacctgttagaaaatgttgtagtggtagaaacacataaaatgaaattgaaggaacatttgggaagaatggatggtgacagaatataagcactgactcctaaataacacttcactagaaaaataggacaggcccaa

SEQ ID NO: 84032 - DNA, 639 bp, Homo sapiens
tatagagatagggtctcactatgttgcccaggctggtctcagaactcctgggctcaagctatcctcctgtcttggcctcccaaaatggtgggattacatgtgtgagccactgtgtctggccagttgttatttttattagtatctccgggagcctaataataataactaacatctcttgagtgtattatgacgtgctaggtattatgctcaatgcttacatgcattactcagtttaatcctctcaacaaccctatgagagagaaactgtcatgctgactctacaaaacatcgaggccccagagaagtaactagtcgtagttcccatagttaggaagagtcaggattccaacccaggagttgaccttacagtctacattcttggcccccaggctcacctgcctgccaggcaggaagttcaagtggttgcatgttgaagggttgaatgcaagaagtggaggaaagagttggtggaaattagtgagctaaagctaggctcggcctgctctgaagcagtctgggtttgcccttagggcaaaatcacctggggtaggtgacagagaagtggaagccatgctcagtttttgacaggctgtgtgaccttgggcagattcttgcttctgctgaaacctccttttcccc

SEQ ID NO: 84033 - DNA, 443 bp, Homo sapiens
aattagccaggtgtggtggcacacgccagtaatagctactccagtggctgaggcacaagaattgcttgaacccagaaggcagaggttgcagtaagccgaaatcactccactgcactccagcctgggtgacagagggggagaccttgtctcaaaaaaacaaaacaaaacaaaaaaacaaacaatgcacgtagtcaactggatgccaaggaaggcatttgacaaaatgtaataccttttcatgatgaaactactaaacaaactagaaatagtaggaaattacctcaatatggtaaaggccatatatgaaaagcttatagctattatttttctcagtaacaagtgaaaaactgtaagcttttcctcttaagattggtaacaagggaaggatgccctctctcaccacttctattcaacgtagtgttggaattccagattaattaggc

SEQ ID NO: 84034 - DNA, 337 bp, Homo sapiens
ccaagtatttattattgttttgttatttgttgttgttgtttagagacagggcctcactctattgcccaggctggagtgcaatggcacaatcatggctcaatgcagccttgaactcctggcctcaagcaatcctcccatctcagcctcccaaagcactgggactacaggtgtaagccaccaagcctagccttataattgttgtgttattactattacatgtcacttagtgcacatgtacaagaaagagtttagggtgtgtacatgcccaggagagggatgtgaaggacaaaagcgtggactgaaagattggcccttcctggcttctgtggcatcccag

SEQ ID NO: 84035 - DNA, 710 bp, Homo sapiens
cggaccttcaacttgcctggggctgtctctgtccctcgggcgaggggctcctggggacccaggacacctggccacggggaggcggggcatggggggcagaaagccagatggagcgggtaggagaaggggggtgctgggaggagtcaaggagggagagagggggcgtgcatggggcgcggagttaagagccaccgagcctgggcgcggtgtgcaggcgagggccacggccttcgcagcagcggggaacgcggggagtcgaggcacccagcgggccggggaagaaggtgggggactccgcggacgccgaggagagggcactgcggagtcagcaggccctgtagggagtcggagaggggctgagcagatcctgaaggcgggcgggggacgcacctttcggcggggcagggtgcccccggacacggcgagcgcgcggtacagctcggcagggtgatagtcctccagcgccgcgtacagctcgtccgctgggggcccaggggtggcggctgcggcagggggtcccggggtcgggaccggagcggcgggcgcgacttccgagtcgggagtccgggcggcggggtccggggtggccgccgcctcctccttctgctgcagcttcctgagtcggcggagggtcatggctccggcgccggacgcccctcagagacggcgctggctcccctcggcggggctggcggcggctgggggatgcc

SEQ ID NO: 84036 - DNA, 336 bp, Homo sapiens
acccatcaaatacccaggaaaataatctcacaaaatatgtgtaagatggttacacagagaatcataaacattgctgagagaaattaaagaagacctaaatcaatagagggacataccatgtttatagattagagactaaatattgtaaagaggaagattcctcctaaattgatctatatatttaaatctaattctgataaaaatcctgcataaaattttgtggaaattaaaaagttgttttttaaaatgtatatggagatgcaaaggagcaagaatagttcaaacaatcttgaagaaaaaaataaaattgggagacttatactctcagatatcaag

SEQ ID NO: 84037 - DNA, 1264 bp, Homo sapiens
ttttttttgtatttttagtagagatggggtttcaccatgttggccaggctggtttcgtactcctgacctcaagtgatccgcctgccttggcctcccaaagtgctggcagatcacttaagcccaggagttcgagaccagccttggcaccatggcgaaatctcatttttactaaaaatacaaaaaattagccaggcatggtggtgtgtgcctgtaatttcagctcctcaggcggctgacgtggatcatctgagctgggaagtcaaggccacagtgagctgtgaataggccactgcactccggcctgggcctggatgatgggtgtgagaccctgtctcattaaaaaaaaaaaaaaaaaaattgtaggtaatttagagatgatttaaagtatatgggaggatgtgcataggtaatatccacatactatgtcattttcatatcagggacttgagaatctgcagattttagtatcaaagggaagtcctggaaccagtcttcagataacaagggacaaatctagttcttcctggggactgtagccgggagtagagcagaaaacaatttctttcgtttaatccacattagatttttatttatatttattttgagacaagagtctcactctgtcacccaggctagagtgcagtggagcgatctgggctcaaagagattctcccacttcagcctctgcactagctgggaccaggtacgcaccaccatgcccggctaatttttgtatttttttagtaaagatggggtttcaccatgttggtcaggctggtcttggactcctgacctcaagtcatccacctgcctcggcctcccaaagtgctgggattacaggaatgagccaccacgcctggccttagatttttaaaagtaacatgcaacactttaaacataaagaaaacgtacttttaagaaaaggaacagtatggactttgtacaaatttccagaaagcaggtaaaagattatatactcttggtaattatgaactactggagttaaatattttacctttttgtctcaccactatttactgagaaactgaggactaaagtatgctttgccaacaccctgacagctatcagacatagctttctttgatttgaggatggcatcacagagatatacttactcaatgtaacaaacacttactgcctactaggtgccaagcactatgaatcataggtaaaataacctctttcaaaccccacagtaataaacttagtcacctattatgactatattcaagataggtccctc

SEQ ID NO: 84038 - DNA, 398 bp, Homo sapiens
gaactaaccgtccttcccagggcacagattcttaccagagtctggctcccaagatcatctatccattccctttttgccttccttcatttcacaaaagctttgaggaagcagtaccagtgtttgcgttaatgggtctgcttcacttattcataaacctctggcctatttcaatactgtgttcaaaatatatatatatttttaaacttaacctccaactggtctccaatttcacatcagtatatttctttatcattagattctttcattttcttattttctgtgtaactacttgggaggctgaggcagaaaattgcttgaacctgggaggcggaggtttcagtgagcggagatcaagcacctgcactctagcctgggtgacagaaacggactctgtctcc

SEQ ID NO: 84039 - DNA, 433 bp, Homo sapiens
ctgggaagtgcccaggaaagctgaggaagttgtgatcatacttagctctctcttttccctgggggagaaaccacaggctgagggaacctctctaggcatggagctgtgatggcctgcagaagggataatgctcataggcagaaggaacttgccttgtcttagatgaaactttggacttgaacttgttgggttaatgctggaataagctaagaccttgagggactgttggaaagactctcctacctacaaatgctgccactgctggatgctgtcaccaggaccaaatcatgagccactggcagtaattctgcaacccccaacactggggaagccacacatttacaaataccccaaggacagatgaactcacccacagataacacctgcagccaaagcatgcactccccagctgcctgcctacagttgctccaac

SEQ ID NO: 84040 - DNA, 340 bp, Homo sapiens
gtcgatctaaggatcccatccccggtctggatatggataaaatgtttggcctgttagatgaatgaaaaggccaatggggttgaaataaaagcatcagtgagggaagaagtattaatagaatgagctgacatcagagaggtagccagaagtcagagagattgtcaggagattgaagcctgctagtactaggagttcaaagaaaggggagatcaatgcatattgagggataacacacagaaagcttctagcataatactgacaccctgtaggcactgtgcatagtgtttattgctattatttttagctattattatttttttgagacagactcttgctctgt

SEQ ID NO: 84041 - DNA, 587 bp, Homo sapiens
aaactgttcatttcattcaaaggttaaactaacaaagaactaagtattttacaacattgtaatacttttgttgttagcacactacaagacttcctgtgaggaaataatatccactcctacagtaaaaattcctgctatttagaaagtttgaggaatgagtccatttgagtagctgttttctaagaaattattttgactagcaaaaaaagaaaaaaaaagtagctattctttattctcagccctttcagaggtaaaatcattacagaagtgtaagcttatcactggctagctgacattttactgtacttgggccagaactccagtaataagtcaaaggaactgaggatgtgcaggtttcttctctcaaggtaacgccaaatgacaatacattatcttacacttgcagctgttctataagcaaagagatagacttcaatgatgtgttggtaatttttaaaagctggcatttccccctacattatttaaaacttcaaatacaacaaaacaggcctggcacagtggctcacggctgtaatcctaacactttgggaggctgaggtaggtggatcacctgaggtcaggagttt

SEQ ID NO: 84042 - DNA, 5915 bp, Homo sapiens
  misc_feature (2)..(2): n is a, c, g, or t
  misc_feature (6)..(7): n is a, c, g, or t
  misc_feature (9)..(9): n is a, c, g, or t
  misc_feature (2833)..(2833): n is a, c, g, or t
  misc_feature (3943)..(3943): n is a, c, g, or t
  misc_feature (4040)..(4040): n is a, c, g, or t
  misc_feature (4193)..(4193): n is a, c, g, or t
  misc_feature (4195)..(4195): n is a, c, g, or t
anactnncngctcgtctcaatttggccctgctgtatttcaagtgctcggtagccacatgtggcaagtggccatcactgtggccattgcagctccaaagggacaggagagttgatggaaattagacactgcattctacagcctcatgagcccaagagagcaaaccttggtttgctgaaaatcagcagataaggcaattgaaagggaagaagaacaacgactatcgtctattccacaagatgagtaacagccaccctcttcgcccctttactgcagtgggggaaattgatcatgtgcacattttgtctgaacatattggtgccttgttgattggggaagaatatggcgacgtcacattcgtggtggaaaagaaacgttttcctgcccacagggtaattttagcagccaggtgccaatattttcgagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgacttggtgggctcgggcaacggcaggaaacggtctcctccctgagcaggggtctctgttgactgcccccacctctgcccctttccagggaggagccgacctagctgcaaaagcagacaccgaacaggttttctcccaaggacagaaaggggctgctttgttcttctcaatttatccaaatcaggcaggtctcaagggggagaaaatgggtcttcaatcttcatcaagtccaccattaacaccctacctctctaatctagcccaggcgcagggaacaggaggaagtcatagacaggcctgtgttggaatacaaaaatggcacgcaaacactcaggcggaggagaaagccattgggcctttgctacctggaggcaccctttaggaatgggcctccatagagtgttcattctgctggaatacattgccctggcaactaaatgattttttatttgttttagttattctccactcagtgaatcataggtgttccggatctatttgaaatgctcaaacagcaaatcactagttttaatcccttttgatgctataattttccttccttggttttgaacggttcagcttgcggggacagagacccatcgtgcatgtctcctaaatgagacacggatgcagctcatcctggcacttgggccacagaggaagtgccacaaatgcacacaagcaaatcaacctgtggacactggagttaatagtcactcgtgtggctgagttactnacctgtcattcctgacatggatccagcctttaagcttgggaggctgacaaggaaatagttactatgcccgctgctaattcactgttccgaagtccatgtagataaacatataccgagttctggcgtggccaaacctgccggggactgccgtggcttagctgcccctccagttgtgtttatcgaagcattggagaggcagccacctgcccatcagcgtcaggaacgcagaactgggactccgtgcttcccccacaccacagtactcaactggggactgaaaaatagcagttccaagaagcttttctcctaatcctcatcaaaaggacctcatttgacgatggtggcttgatgtggctccgtctcctacttagtgatttccattccagtgctgcctgccctgggtaactgcgcacaacattgcctgcccctccgctgtccccagagctccggcctctgtcgccatcagcatcagcctgggagtctccccaggacggcatggcacgtgagcagcactgcagtccttgggtcttcggcgccaacctgcaaccctgatcaaaggagggtgagggcgtgggagtttcctttcaggtgtgtcaaagacatatcagctgcgctctagaaagagccaacgggtcagccgcttcctcctagtttaacttgattttgagtgatttgtccatatggaaatagtagggtactccagctgcagggctgagctgcttcctatcccctcagctctgatctctgccacttccctgttgtgtgggagagtggaacactcctgggatgccaggcatttcataatgggaggaggctcctgtaaggaacggtgggcgcccgctcacagtggggggccctccagcatggttgctgactctgtcagcccccagccccgggttgccaattagccagagagctcctgcacacacagcacttccttccccagtgtgttttctacccagatggggacaaaggagccagacagtcatatcaagggcagagttcaaacattttgaaatgagccattcacatgcttctttttaaacatgggcatcacctgcccagaggcccttggcctgaagcagcatgctgctgaccttgggaagaganggtgggctggtgggggtgctggaggagctgcccggccctgcatctgcaaccctccagtcccctgcccacagagcacgcagagccctcctgtgctccnggaacgagatagcagcttggcagctcggcctcgcatctgaaaaggaatacgctgcaaagcctcggccctagacccacatctgcagctccctggcctgtggcggttctttccttcggggcatgcccttccagatctctgtccctcctgtcttcnancactttaaagatgccccttatcatcagataaagagaagtatggggacgatggggtggcactaacagtagatgtcattggtgaggactgatggcaaagtctcattccctcacagccgcgctgccagctcgcctccccctcgctttgctgggagcctgccctggactccaaaaggacacgggttcacctcctttcccaggctggaggggtactgcccttccctgaggggccttctgactggggcaggaactcttttcgtgtgtccagctgggcctggaggccaagtcaaggtgtgtcacaccacacaccagggcaaggacctcatctccagggaacagggacaagtgagtggctaccagaaagtccccgggcagcctggagttccccagagcctggctggtcctacagagcacttctcccctgggccaccaggaccaaagcgacctaaacacttgaagctaaaagcaagtgctgatgatgggatgggctggcacgtggctgggagggctcctgggcaccacagagccctcagcccagcagagagtggaggctcagtccgcggggagtgggggttgtgaaggagacatggccaagcccctggtcggggagataagctcccccatgcccaggccagccccaggggcaacaagccaacatggagagaggtggcaggtgaggctgacaggtgggtgcctgtggcctgggcccatgagggcaatggtcctcagtaaccaatggaaaggacacaagggcgccgtggtcaccaccacccaggcaaagaaatgggaggtggccagcacccccacccttcacttttcattattattattattattattattattattattattttttttttttttttttttggagagtagaaaggcaacttcattggagcttttggggaaaaaagccttcaaagtcaccttctggcagctctggggagggtcatttggggtggactgagagtgtagggcaggtagggtgtgtgccgggcagcagctgtgtccgtgcagccagcacccagcagggcagtctcacaggagccgttgtgagcactttggacttgaagcagctatgaaccaccccccgcccccaccgtctctccctctcacacacacacacacacacacacacacacccgttttaccattttctcagtgctttttctgctttcattcctttgattttagttagaagcacaagccatgatggatgtgggactcttctcaattgctctttaaattgtcactttttaaatcctattaaatgaagtgtcgattcctgacaaatacattaaaagtgttttattcctagaagagttgggaaaagaaattattttcagcaagagtaggatgtttgttaaactgattccttggcaaaaaagagaaaaaaagcttttgaattgtgcaaaaaattgcccagtattatgctgtcgccccagttgtcaaactgctgtgcagatggctccagcccagtcaacttcaccttctttttaatttagaagataacaaaattgtaatcacttatcctttccagagccaagggggaaaaggaaggtataatctacaataaaaagcgagcgttctgtgtactgaggccacttggtgataaagagatggagcgctcccctcacagacttcaattaagaacctccctttggacagggaagaaaggtgtcaaagaggaaaagaaaattaaatttgcttccttccagga

SEQ ID NO: 84043 - DNA, 2682 bp, Homo sapiens
  misc_feature (2)..(2): n is a, c, g, or t
  misc_feature (6)..(7): n is a, c, g, or t
  misc_feature (9)..(9): n is a, c, g, or t
anactnncngctcgtctcaatttggccctgctgtatttcaagtgctcggtagccacatgtggcaagtggccatcactgtggccattgcagctccaaagggacaggagagttgatggaaattagacactgcattctacagcctcatgagcccaagagagcaaaccttggtttgctgaaaatcagcagataaggcaattgaaagggaagaagaacaacgactatcgtctattccacaagatgagtaacagccaccctcttcgcccctttactgcagtgggggaaattgatcatgtgcacattttgtctgaacatattggtgccttgttgattggggaagaatatggcgacgtcacattcgtggtggaaaagaaacgttttcctgcccacagggtaattttagcagccaggtgccaatattttcgagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgataggttactactttgggattgtgacactcaaagtggacacagtggaacacctgggagagaaaaggaaaagaccccatgagtgaagggtcagcatgcggccctggagttgccgcaagttgggatactgccctgcccagctttgggggccaccacgagggagttagaggaggtccttcccactgcccacgcctgccccggcgcagacacctgatggcaactagcatgctgtaaacacattttgatcagtcaagaggaaaggaaatgagccagtggcccaaaagttagagacaccatgacacggattcccacaaaatcttcacactggattactccgtttttgccaacctttgtctaatgggctctttttttcttttttaattaatttttgtatttggcagttgggttaaaagtcaacaggagttgactggtggtggtggtggtggtggttcgattctgtgaggttgtggaaagcaggtccacagataacgtccaccatctgtgtggcatctgcgtgggttgtctctgggtattctggttttctcccgcgtcccaaagctgtgcacttgaggttcattggtgtgtctgcagggtcccagtctgagtgcatgtgaatgtgtgtgagcgtgccctgcaatggcatggtgtcctgtcctgagctggttcctgatgcatagttctcctggccctgcaatggttgagcacagaccctgctaagcagccgtgctggggagtggacttcaacctcatgtggctccagccagcctggaacaaacgcccccaatgtgtagaagccagccacctggccgacagtcaccctctaggagctaagaagagtttgcatacctgacagcaggtcagcctggaagcaccatgaactctgtgccaacaccgtgccagcactgtgcagacagggcacagcaccgagctcagcgccccgcaagcaagggtaagccatggccctgacctggagagtagacaacgtgcttcggggggtcctgacatgcatgtgtgagctgtggggtgcaggagagaagggcggggtgggggctgtcgttgccactgcacgagcatgtgtgcacatacatacacacggccttctaccgtagaatcaagttcacagagacaaatgtagtatcaactgcagaattatattgaaaatataaattccacgcttaaaaaaaaaa

SEQ ID NO: 84044 - DNA, 2851 bp, Homo sapiens
  misc_feature (879)..(879): n is a, c, g, or t
  misc_feature (976)..(976): n is a, c, g, or t
  misc_feature (1129)..(1129): n is a, c, g, or t
  misc_feature (1131)..(1131): n is a, c, g, or t
aaaaggagagaaaaaccattcaataccagaggagtgagcttgagaaaaggtaataaggagtaggacaaacgtaagtcaattccaggattagtgtcagcctgaggctctggggagcggcctccggagatattgaccgagcagggagagcagggattacacaaataaccaattaaagaacatggtggggccggataaagagctctgtccccagagctccggcctctgtcgccatcagcatcagcctgggagtctccccaggacggcatggcacgtgagcagcactgcagtccttgggtcttcggcgccaacctgcaaccctgatcaaaggagggtgagggcgtgggagtttcctttcaggtgtgtcaaagacatatcagctgcgctctagaaagagccaacgggtcagccgcttcctcctagtttaacttgattttgagtgatttgtccatatggaaatagtagggtactccagctgcagggctgagctgcttcctatcccctcagctctgatctctgccacttccctgttgtgtgggagagtggaacactcctgggatgccaggcatttcataatgggaggaggctcctgtaaggaacggtgggcgcccgctcacagtggggggccctccagcatggttgctgactctgtcagcccccagccccgggttgccaattagccagagagctcctgcacacacagcacttccttccccagtgtgttttctacccagatggggacaaaggagccagacagtcatatcaagggcagagttcaaacattttgaaatgagccattcacatgcttctttttaaacatgggcatcacctgcccagaggcccttggcctgaagcagcatgctgctgaccttgggaagaganggtgggctggtgggggtgctggaggagctgcccggccctgcatctgcaaccctccagtcccctgcccacagagcacgcagagccctcctgtgctccnggaacgagatagcagcttggcagctcggcctcgcatctgaaaaggaatacgctgcaaagcctcggccctagacccacatctgcagctccctggcctgtggcggttctttccttcggggcatgcccttccagatctctgtccctcctgtcttcnancactttaaagatgccccttatcatcagataaagagaagtatggggacgatggggtggcactaacagtagatgtcattggtgaggactgatggcaaagtctcattccctcacagccgcgctgccagctcgcctccccctcgctttgctgggagcctgccctggactccaaaaggacacgggttcacctcctttcccaggctggaggggtactgcccttccctgaggggccttctgactggggcaggaactcttttcgtgtgtccagctgggcctggaggccaagtcaaggtgtgtcacaccacacaccagggcaaggacctcatctccagggaacagggacaagtgagtggctaccagaaagtccccgggcagcctggagttccccagagcctggctggtcctacagagcacttctcccctgggccaccaggaccaaagcgacctaaacacttgaagctaaaagcaagtgctgatgatgggatgggctggcacgtggctgggagggctcctgggcaccacagagccctcagcccagcagagagtggaggctcagtccgcggggagtgggggttgtgaaggagacatggccaagcccctggtcggggagataagctcccccatgcccaggccagccccaggggcaacaagccaacatggagagaggtggcaggtgaggctgacaggtgggtgcctgtggcctgggcccatgagggcaatggtcctcagtaaccaatggaaaggacacaagggcgccgtggtcaccaccacccaggcaaagaaatgggaggtggccagcacccccacccttcacttttcattattattattattattattattattattattattttttttttttttttttttggagagtagaaaggcaacttcattggagcttttggggaaaaaagccttcaaagtcaccttctggcagctctggggagggtcatttggggtggactgagagtgtagggcaggtagggtgtgtgccgggcagcagctgtgtccgtgcagccagcacccagcagggcagtctcacaggagccgttgtgagcactttggacttgaagcagctatgaaccaccccccgcccccaccgtctctccctctcacacacacacacacacacacacacacacccgttttaccattttctcagtgctttttctgctttcattcctttgattttagttagaagcacaagccatgatggatgtgggactcttctcaattgctctttaaattgtcactttttaaatcctattaaatgaagtgtcgattcctgacaaatacattaaaagtgttttattcctagaagagttgggaaaagaaattattttcagcaagagtaggatgtttgttaaactgattccttggcaaaaaagagaaaaaaagcttttgaattgtgcaaaaaattgcccagtattatgctgtcgccccagttgtcaaactgctgtgcagatggctccagcccagtcaacttcaccttctttttaatttagaagataacaaaattgtaatcacttatcctttccagagccaagggggaaaaggaaggtataatctacaataaaaagcgagcgttctgtgtactgaggccacttggtgataaagagatggagcgctcccctcacagacttcaattaagaacctccctttggacagggaagaaaggtgtcaaagaggaaaagaaaattaaatttgcttccttccagga

SEQ ID NO: 84045 - DNA, 837 bp, Homo sapiens
ctatatctataccacagcccccaatcctttcaaaggctttgcatgtatttcagctacaagtgacaaggatattaaggatttaaaaggataagagagtgggaaagatgtataaggaagtgcctttgtcaaaaggcagcaaaaagtataatgatataaacataatatgaaataagcaaattttagaatactttgaaacagatttatagaggaatacatagtaaatagttatagacacacacacacacacacacacacacacccgttttaccattttctcagtgctttttctgctttcattcctttgattttagttagaagcacaagccatgatggatgtgggactcttctcaattgctctttaaattgtcactttttaaatcctattaaatgaagtgtcgattcctgacaaatacattaaaagtgttttattcctagaagagttgggaaaagaaattattttcagcaagagtaggatgtttgttaaactgattccttggcaaaaaagagaaaaaaagcttttgaattgtgcaaaaaattgcccagtattatgctgtcgccccagttgtcaaactgctgtgcagatggctccagcccagtcaacttcaccttctttttaatttagaagataacaaaattgtaatcacttatcctttccagagccaagggggaaaaggaaggtataatctacaataaaaagcgagcgttctgtgtactgaggccacttggtgataaagagatggagcgctcccctcacagacttcaattaagaacctccctttggacagggaagaaaggtgtcaaagaggaaaagaaaattaaatttgcttccttccagga

SEQ ID NO: 84046 - DNA, 3046 bp, Homo sapiens
  misc_feature (2)..(2): n is a, c, g, or t
  misc_feature (6)..(7): n is a, c, g, or t
  misc_feature (9)..(9): n is a, c, g, or t
  misc_feature (2833)..(2833): n is a, c, g, or t
anactnncngctcgtctcaatttggccctgctgtatttcaagtgctcggtagccacatgtggcaagtggccatcactgtggccattgcagctccaaagggacaggagagttgatggaaattagacactgcattctacagcctcatgagcccaagagagcaaaccttggtttgctgaaaatcagcagataaggcaattgaaagggaagaagaacaacgactatcgtctattccacaagatgagtaacagccaccctcttcgcccctttactgcagtgggggaaattgatcatgtgcacattttgtctgaacatattggtgccttgttgattggggaagaatatggcgacgtcacattcgtggtggaaaagaaacgttttcctgcccacagggtaattttagcagccaggtgccaatattttcgagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgacttggtgggctcgggcaacggcaggaaacggtctcctccctgagcaggggtctctgttgactgcccccacctctgcccctttccagggaggagccgacctagctgcaaaagcagacaccgaacaggttttctcccaaggacagaaaggggctgctttgttcttctcaatttatccaaatcaggcaggtctcaagggggagaaaatgggtcttcaatcttcatcaagtccaccattaacaccctacctctctaatctagcccaggcgcagggaacaggaggaagtcatagacaggcctgtgttggaatacaaaaatggcacgcaaacactcaggcggaggagaaagccattgggcctttgctacctggaggcaccctttaggaatgggcctccatagagtgttcattctgctggaatacattgccctggcaactaaatgattttttatttgttttagttattctccactcagtgaatcataggtgttccggatctatttgaaatgctcaaacagcaaatcactagttttaatcccttttgatgctataattttccttccttggttttgaacggttcagcttgcggggacagagacccatcgtgcatgtctcctaaatgagacacggatgcagctcatcctggcacttgggccacagaggaagtgccacaaatgcacacaagcaaatcaacctgtggacactggagttaatagtcactcgtgtggctgagttactnacctgtcattcctgacatggatccagcctttaagcttgggaggctgacaaggaaatagttactatgcccgctgctaattcactgttccgaagtccatgtagataaacatataccgagttctggcgtggccaaacctgccggggactgccgtggcatcgataaacaccggtgtttatcgatgccacccccccgactagccaaccgtgtactagt

SEQ ID NO: 84047 - DNA, 229 bp, Homo sapiens
catagagcgagaccctgtctcaaacgataggacaggacaggacaggacaggacaggacgaagagaagagaggagaaaagaagcgaagcgaagagaagtatccgcatatactttaagcatcacaagaagaaatacctaccaatatatggcccaaatttggggtttaaaaaaaagaaaactctaagctagagacatgctttccaaatgtacctttttaaacataggcagtg

SEQ ID NO: 84048 - DNA, 708 bp, Homo sapiens
cccgcgcaggctaccgcagcatagatcgaggtatctgagaaggattcggcggcaactctgggccaaagaggtggcctgacagtctgggagggctccgcactcaccggactccaggattcctgcgcgcagaaatccaggcccccagcctcgctagggcgaccttccgcgcgacctcacttcggccctcctagaggaaagactttgccttcacacgcgattactttcactggagatcacgacccggagacgctggcgactgggccagcgcctcccatttcggttcacctccagttcaccgccccctctgagtaagaaacccttggggaggggtggcgagggagtgggggataggcattctctgctcagtgcagaacggcaatgaaatgattggcaaaggtcacagggattctggtccatccgcgtaccacctctccccccatgtatataccgctgtctgtgtgtgggctcgtggggagctgtctcggcgtttctgataagcacagctggtggaagcccacagcgacgatccagcgagctagcgagcgcccgggaggctgggttcctgctttttaaaatataaatatatatatatttttaaatctctgtgtgtatgtgtctctgtgcgtgtgtgtgtgtgcgtgcgcgtgcaaacgtgtgtgtgtagatagctgtgtgtatcgcgttactatgtacaaaaacaaaaagtac

SEQ ID NO: 84049 - DNA, 446 bp, Homo sapiens
ctagaccaggctatttggcactggttgattgaatgtgaactgcactggggctgctgtgagcccgcatgggtctctgtgaccctgcagatgcagccgtgcccagggactgggcagtgggtgtgggctggtgtgagccctgtctgccacccagggcctggccctctgtctgtgtcggccatgactatggtgagtcttgtaggcttgagactgtgcctcgggttcctgcgggttctctgtaggtcagttgacagtttctcctgttgtttgggtaactgtggaaacgaacactggcaagtgctgaagcgagcatgtggacgtgcgatatgaaataacgacctggctttcaaaggcagtgaggctctctggaaaggaccttgctgagctagggatgtgggtgtgtagccattcccagtgggcctcatggcgtactcgttcatgatcatgtt

SEQ ID NO: 84050 - DNA, 721 bp, Homo sapiens
cagcacttctggcagttaagaagtccagttcttcaactcactaagctgccttctggagcccgaaccaggaatgcagtgataaagagatgcaggctggaaaagtttgaacaacctggccccagattccccatctgtgaaggggcactgaggctaggtcgtacttgggcaatttttgtgctgcccttagctcatgagccccttcaccaaagctaggtgacctctgagtcccttcatattagaccagagatcccaatcgtggggcattgcagccccatcatgtgtgggttgtgggcctcccatgctcctaaaagcccagtgcaatcaaaatagctaatgattattaaaaactttttggattgcagatgactgacaggtatattcccacatgagctagttattattatcttgtttatacagtcaagacatttgaagtccagaaatgtgaccgattcacacagctagactggaacttcaacccaggccccttacactccaagttcaaggctttttccatcgtgatatgctattttaaaatccgagtggattaaaattaaatttttttttttttttttttagacggagtctcgctctgtcgcccaggctggagtgcggtggtgcgatctcggcttactgcaagctccacctcccaggttcatgccattctcctgcctcagcctcctgagtagctgggacaacaggctaaaattaaaattttaacttg

SEQ ID NO: 84051 - DNA, 346 bp, Homo sapiens
aaattagccaggtgtggtggtacacacctgtaatcccagctactcgggaggctgagacaggagaattgcttgaacctgggaggcggaggttgcagtgagctgagattgtaccactgtactctagcctgggtaacagagcaagactccgtctcaaaaaaaataaaataaaaacacaaaagcactcttaagaggcttttctttgttttttgtttttacaggtgtgagatctttttggttactggttattgttacagtaaatttattgttggaaattttactgtaaattggctaatgtctgaaaagactcaggtcctcatttgtttccctgttgtcattgttccacagc

SEQ ID NO: 84052 - DNA, 599 bp, Homo sapiens
ggcaaaggggaatctggcgctccctgggaaggcggccaacgcggttctcctctggagtggttgagtccagctgcaggcctttccccatccacaggggctgttccatgatggggtcaagatttgggtcacccacccatggtccggggagaagtgactccccaaggtcacaaggccaccaccaatagagccaggatggggttccaggtggcttgacttggcagccagcgcctgtgcccatggcaccccctcaccccagctgtctgggttattttgggcttcctcccgtgccagctgtctgctggcatccctgcccgggactgtctggttggaagtaactggcgtggtgctgttggctcctcctgtgagggccagggctgggtcttcaatccccgatgagccgtgctgggtccagctcctttgctgggagggaagagtgttcctgcccagactccccgctgcccaagtacagcaagagggcgaaagcacctgataaaaattgaggttcacattgttaatatcccaaaagcctcctccttctatactccctgaaacctgttttaaatttggctctgccattgaaccccgttgctctcacgtta

SEQ ID NO: 84053 - DNA, 404 bp, Homo sapiens
aatttctaaaattgaatagttgtgtattgaaattccacagagcatcatttcctttgagacaaaaggaaactgtgttcactttagctgtcatttttttcaaagtcaatcccagtacttttttatgttaacattttaataatgcataacattctataccatattttatcagaaacaaatttgttctattgccccaaaaaatcacttacatgagatatttgttgtcatgctttgtcaatatacagatgtaaatatatttatcatttacatataaatgaatgttcgaacacagacacttggcttttgacatatacataaatgtgtctgtgaatgattacagaagtgatcagggcctcggcatttcccttggaggtagcaaagtgtctcctagactttcagctgttttt

SEQ ID NO: 84054 - DNA, 297 bp, Homo sapiens
gctggaactcctacaatgtatatattggtctgcttgatattgtcccatgggactcctaggctgtgcttacttttcttcaatctttttcctttctgttcctcagacttgctaatttccattgtcctatctttgagtttgctgattttcttctgcttgctcaaatctgcctttgaatccctctagtaaatttcttatttcaattattgaacttttcagcttcagaatttctttttcctttctaggttttctcttaatattcctattttgtttctacatagttttcttaactttctccat

SEQ ID NO: 84055 - DNA, 585 bp, Homo sapiens
gaggaactcagagcagccttgagaagaagctaaaacatttggtaacaacaatcagaaagaacaatgtcaggtctgccatacaaaagtgaaaatatttgcagtggggagcaagtgggtaagtaatagactgaatacttcctgtcttaggctgatcaggtgccataacaaagtactgtagactgggtgacttatcaacaacataaatgtattttttacagttttagaggctggaggtctgagatagatcagggtgccaacatggttgggctctgatgagggccttcttctgggttgcagatggctgtcttctttttgtattctcacatggaggaaagagagcaagctagttccctggactcttcttataagggcattaatctcattcctgagggctccatcctcaagacttaattacctcccaaaggttccacctcctaatataatcatatttggattaggggtttcaatatatgaattttgggggaacacaaatagtcagtccattgcaccccggccatgccccgcaggcctttctttcacgacatgaagatttccttacaaccaactcagttgatgggtccatta

SEQ ID NO: 84056 - DNA, 329 bp, Homo sapiens
gattttaaatagttaaaacatttttttaaatccataagtaattcttactctactcatttatacacacatatactcacatgtacacagacatacctacacacacacttataaatacatgtatacacagaatatagcaaggtcttttatcccttttcaatgaaataaatattgtattctatatttagaataaataatgttgaaaaagtgattttggagaaaggttgaaatgattgagtcttaagtgtgtcaatgtataatctacccctttctaaacatcgtgttttaagtagtcatcttacttcagaaattagaggttcaatgtgtttaga

SEQ ID NO: 84057 - DNA, 508 bp, Homo sapiens
aaaggtttcatttacaaatctcaatttctggcttatgagatctagccactgggggtcttcatacccacgaggacataagggcttccagtttgtctggtccccacccactccccaggcctccctggagcttgctggagggacactcgggaaaatgcaaagcaattacctcctgcagcaggtagaacctgtgcaagtattcctctcaaggttgttcaggctgtgactggacagattcaggctgagattgcgaactgctgggtgcccactgggtgacaggtgtggtgccactcccaccagcagccccccagagggcatgctgggcctcagccactgccaggggactgtgaggaggagccgaggatgcagcctcgtgttgggcccatgcccgttcccagccactcagtctttcccactgtctacctcctgccccggtgcttgcttccaactttgcatctcatcacagaggatgctgtccgttctgcagatgggacaattgaggcatggcagt

SEQ ID NO: 84058 - DNA, 2284 bp, Homo sapiens
gcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatag

SEQ ID NO: 84059 - DNA, 2023 bp, Homo sapiens
gcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggccaccacgggcagtgaccccagtttgtctccggattcccaagacccgtcgcaggacgacgccaaggactcggagagcgcccggcgccacgccttcttccgcagtccgcgccggatgcggccgctggtggaccgcctggagccgggcgagctcatccccaatggtcccttctccttctacggagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatag

SEQ ID NO: 84060 - DNA, 988 bp, Homo sapiens
accgtgaaatggaaacgcggtgtgtgtctgacattattttggagaggcgtagtctctatgtgtgtacagccccagagaagcggtaactgtgatagtgtgactgttagaaaaactccagctataccacaactctccccctccagacacggcggcctgtccaggtcctcctgtgggattcctgctcaccattggctcagggtccgccctgagtggtcctagtcagagatcgcaccgtcaccactaccctacacacacacacaagcgcgcgcgcgcggtgtcggctagccaggcggtgaaggggtgctggctaggcccggagcaccccggggtcgggggtggagtctcggtggcctcaccccgccgccatgtgctgcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatag

SEQ ID NO: 84061 - DNA, 421 bp, Homo sapiens
gctcatccccaatggtcccttctccttctacggaggtgggtgcgcgccgaatggcggggcacggccaggtcggggcgggcttcgttggaagcgggtggcagcgcgggggggcacgcctcgctctctgtaagccactggagagttggggcgagtagggagaaggctgggagtaaatcaaggggaggcggcgagaccgaggacccaattcacggccctgaataacgggggtagctggtaaggggcagctcccgggcttgcgcccagcctcctccctgcacccaggcccgcgagggctccccgcgatccgcgagttccccgcgtggccttcctcagcccgccgaggtcgcgtcttccctccctttcggtcccgccggcccccggccgggccctgacgtcctgcgccctccccgccgctccgcag

SEQ ID NO: 84062 - DNA, 2282 bp, Homo sapiens
gcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcaatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtg

SEQ ID NO: 84063 - DNA, 790 bp, Homo sapiens
  misc_feature (18)..(18): n is a, c, g, or t
gccggacgccgtcttacntccccgcgctgtctcggcggcccaggaattcactgtctgtagcatctgctcctccacagagggaccctggaatggcgatggcactcccgatgcctggacctcaggctttcttgttgccaaaccagcactgatctccctattggagcaaggagaggagccgggggccttgattctgcaggtggctgaacagagcgtggccaaagccagcctgtgcacagaggaccctaatacactgcccagcagaagccaggaaggaagccctgccagctcagaaggtgggccaggagagaagggtgtggccggaagggtagccggtgggggtgctgcatcctcttggccccacggggagcaccctgtcacccctaacagatgaagagaagggtttctggtgtctccagatttttcaggcgcccaccatgttcctctcatccagacgtcggcaccccaaggtggaagcaggtcatggcatgcccggcccagctgcagtccgagtgcagatcccatggcgagcgtgggatccagcccaaagcacaagccacgcacagcccgcccaggttgagtgggcaggtacctccaacagccagcccaggttgagtgggcaggtacctccaacagcctggagccgtgaggccttgcgcagggcgttgccggccgtggaggtctctggctggcaaagtggcaccgaaagagtcctgtgtcataaccagactcacttgtagcttctgttgctctccctagctatttgcaaagcatccaggataggttcatctaa

SEQ ID NO: 84064 - DNA, 499 bp, Homo sapiens
ggcagctggcgaagcattgtttctgagtgtgtgaggatgttttcagtggactcagtgaagatctgccctcagcgtgggcaggcacatccacttggttggggacccagatggaacacaaagggagaagacaagcaaattctcttttctggagggagacacccatctcctgcccttggacatcaggactccaggttcttcggcctttggactcaggcttgccacagaggcctcccagggctctcggccagtcagcctcagaatgagagttacaccactggcttccttggttcaaccaccttcttacctggactgagcctcacttacagcttctctaggtctccagcttgcagacagcctatgggaggacttctcagcctccataagtgtgtgggccagttcgcctaataaatcccctctcctggccgggcgcggtagctctcccctgtaatctcagcattttgggaggcagaggtaggtggatcacctgaggtcaggagtt

SEQ ID NO: 84065 - DNA, 628 bp, Homo sapiens
  misc_feature (18)..(18): n is a, c, g, or t
gccggacgccgtcttacntccccgcgctgtctcggcggcccaggaattcactgtctgtagcatctgctcctccacagagggaccctggaatggcgatggcactcccgatgcctggacctcaggctttcttgttgccaaaccagcactgatctccctattggagcaaggagaggagccgggggccttgattctgcaggtggctgaacagagcgtggccaaagccagcctgtgcacagattccaggatggaggctgggatcatggagtctcctctgcagagaaagctctccaggcaggcaggactgccgggcaccgtgtgggggtgcctcccctgggggcaccctgtgggggggcaccctgcaccatcccacccgcatggcggtcctgaggacgggtcagataaacccacccaccccgggtcttcgtgcagaaccattgggcacagccaggccttagcgccaggctccgtgtggcggtcaattccaggtgctgtaaagccgactaacagggtacagggagccttagctggctgccatgtctcctgcctgtaatcccatcactttgggaggctgaggtgggaggtttgcttaagcccaggagtttcagaccagcttgggcaacatggtgaa

SEQ ID NO: 84066 - DNA, 446 bp, Homo sapiens
aggagttcaagaccagcctggccaacatggtgagacccccgtctctactaaaagtacaaaaagtagctgggtgtggtgctgggtgcctgtaatcccagctactcgggaggctgaagcaggagaatcacttcaacctgggaggtagaggttgcagtgagccgagatcgagccactgcactccagcctgggtgacagggcaagactctgtctcaaacaaataaaaatcccctctcctaaactccattattggttttgtctctctagaggaccctaatacactgcccagcagaagccaggaaggaagccctgccagctcagaaggtgggccaggagagaagggtgtggccggaagggtagccggtgggggtgctgcatcctcttggccccacggggagcaccctgtcacccctaacagatgaagagaaggtgaggggggattgagttac

SEQ ID NO: 84067 - DNA, 774 bp, Homo sapiens
tctgtcttcacttgattgtggtatcatttcacagtgtagatgtttattgaatcatgttgtacaccaaaaatatatacaagttttgttttaagacagtctcactctttcgcccaggctggagtgcaatggctcgatctcggctcactacaacctctgtctctgggttcaagcaattctcctgcctcagcctcctgtatacaagttttatttgtcatttatacctcagtaaagctgggtgttgggggaagacttgggaataaaaaggttatgtcttcaaacaagaagttcgtttgtgagtgtagaggctggatcatccttccgttttctgttccttctctcagattccaggatggaggctgggatcatggagtctcctctgcagagaaagctctccaggcaggcaggactgccgggcaccgtgtgggggtgcctcccctgggggcaccctgtgggggggcaccctgcaccatcccacccgcatggcggtcctgaggacgggtcagataaacccacccacccccgggctctgggagcacagcgcctccccaagggttctgcaggaacgacctgggccggcgcatttgggggagactacagcctcgagcgtctacactgtgcagggtgccgcccatggttggtgcagtataccatctacgccttgctgcatccaggcgtttcctatcattccaatcacccggagcgcaagcaacttgccagtgactccggattgcgggaaggccctactagcccacgctcgattcctgcataggaaga

SEQ ID NO: 84068 - DNA, 584 bp, Homo sapiens
tgggcttcctgatgacggggacgacaggccgaggattcacgctggaagcccacccaagccggcggggccctagcgcagaaattcagaagccccctgtcctgaaggtgaagcaaagtctaaagaaagggccagctcccatcaggagctcggcttcttgctccagccgggcactggggagggaaagggcaccaggcagcccgtggtgtggcctcaggaaccactatcagccaccatttcctggggccttccggaaatgtccaggagcgggcagaagggagagagggaggggcagctatgctcagtccccaaagagcagggcacatgggggcgccacagacgcatatgcagctgagctccccacaggccggcccgggtcttcgtgcagaaccattgggcacagccaggccttagcgccaggctccgtgtggcggtcaattccaggtgctgtaaagccgactaacagggtacagggagccttagctggctgccatgtctcctgcctgtaatcccatcactttgggaggctgaggtgggaggtttgcttaagcccaggagtttcagaccagcttgggcaacatggtgaa

SEQ ID NO: 84069 - DNA, 884 bp, Homo sapiens
  misc_feature (164)..(164): n is a, c, g, or t
  misc_feature (576)..(576): n is a, c, g, or t
  misc_feature (701)..(701): n is a, c, g, or t
  misc_feature (761)..(761): n is a, c, g, or t
gtaaccctcaagcactaggaccgtgcggaatccaggctgcgatggcaccttcatttaccgcccgcattcagttgttcctctggcgggcgctaggctttctcataggcttagtaggccgagcagctttagtcttagggggtccaaagtttgcctcaaagaccccncggcggtgactgaaccattgcttctgctttcggggatgcagctggccaagctgatccgacagagaaaggtgaaatgtatagatgttgttcaggcttatatcaacagaatcaaggacgtgaacccaatgatcaatggaattgtcaagtacaggtttgaggaagcgatgaaggaggctcatgctgtagatcaaaagcttgcagagaagcaggaagatgaagccaccctggaaaataaatggcccttccttggggttcctttgacagtcaaggaagctttccagctacaaggaatgcccaattcttctggactcatgaaccgtcgtgatgccattgccaaaacagatgccactgtggtggcattactgaagggagctggtgccattcctcttggcataaccaactgtagtgagtngtgtatgtggtatgaatccagtaacaagatctatggccgatcaaacaacccatatgatttacagcatatgtaggtggaagttctggtggtgagggctgcacactggcagctgcctgctcagttantggtgtgggctctgatatggtggtagcattcgaatgcctgctttcttcaatggtatattnggacacaagccttctccaggtgtggttcccaaacaaaaggtcaggtatcccttggctgtgggagcccaggagttggttcctgtgcactggtcctatgtgccgtattgcggaagacctgggacc

SEQ ID NO: 84070 - DNA, 273 bp, Homo sapiens
gcccaaactgctaaatttttttttattgatgatagtatgaaattggacagataaacagaaaactttgtgaattaagccgattaatcatctcagctttctgcagatcagttcaacatcatatgctcttcactcctcatctggttattttgaagttcaaatgcaaaagtatacatgaaagcactttgttatacaagtatgaggtataattcctaccggtaataagtaggataaagaagttgaatacatattggagacagatcaatactacttcac

SEQ ID NO: 84071 - DNA, 364 bp, Homo sapiens
cttccgcgcagtgagccatcactacggatacgggctgctggacgccgggctgctggtggacaccgcccgcacctggctgcccacccagccgcagaggaagtgcgccgtccgggtccagagccgccccacgtgagacccctgcgcgcccctccgctatccccgctgggggtgtgggggacaggcctgaggcctcagtttacccatctgtaaaacgagggctggaccccgtgacctctgagccccgacctcgcctgctggccgcccacccaccccccagcaggccgcaggagggtcctcacccctcgaccccctcagccccatcctgccgctgatctacatcagggaaaacgtatcggcctgcgcc

SEQ ID NO: 84072 - DNA, 1410 bp, Homo sapiens
cgccaaggtgcggcggggccgggcgggggcggggacccggggcccacggggcgagtgactgctgcccttccgcgcagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgacccttggacgtcagcactgaaggctacaacaactgggtcttcatgtccacccacttctgggatgagaacccacagggcgtgtggaccctgggcctagagaacaagggctactatttcaacacggggacgttgtaccgctacacgctgctgctctatgggacggccgaggacatgacagcgcggcctacaggcccccaggtgaccagcagcgcgtgtgtgcagcgggacacagaggggctgtgccaggcgtgtgacggccccgcctacatcctgggacagctctgcctggcctactgccccccgcggttcttcaaccacacaaggctggtgaccgctgggcctgggcacacggcggcgcccgcgctgagggtctgctccagctgccatgcctcctgctacacctgccgcggcggctccccgagggactgcacctcctgtcccccatcctccacgctggaccagcagcagggctcctgcatgggacccaccacccccgacagccgcccccggcttagagctgccgcctgtccccaccaccgctgcccagcctcggccatggtgctgagcctcctggccgtgaccctcggaggccccgtcctctgcggcatgtccatggacctcccactatacgcctggctctcccgtgccagggccacccccaccaaaccccaggtctggctgccagctggaacctgaagttgtcagctcagaaagcgaccttgcccccgcctgggtccctgacaggcactgctgccatgctgcctccccaggctggccccagaggagcgagcaccagcacccgacgcctggcctgccagggatgggccccgtggaaccccgaagcctggcgggagagagagagagagaagtctcctctgcattttgggtttgggcgggagtgggctggggggagaggctggagcaccccaaaagccaggggaaagtggagggagagaaacgtgacactgtccgcctcgggcaccgcgtccaacctcagagtttgcaaataaaggttgcttagaaggtgaaaaaaa

SEQ ID NO: 84073 - DNA, 373 bp, Homo sapiens
actggcatgctctttctttgtcttcttttgaatgtagctttgccactctagatgggagaaaatgcagctggtcattgatggctgtggcttttctcctacacccttgctgggcagaggtgatgcttttcccacctgttcctgaggatggcttgcagaaatcctgctaattctctctgctgcactgctttccctcaaagaaggctccggctccgtggagaccaggggctgggtggaaaggaagaggccagccaagctgtcatgggaatttggtgactcatttcatcagtttactgctctgaaaatgaggtgacttccccctttgcttgacaactgattgatgaacatttcctgagtatttgcagaatagatgttt

SEQ ID NO: 84074 - DNA, 441 bp, Homo sapiens
ggaaatactttcctatgtgttgtgaacactacaaccctttcccacatcctcctatgcttcgtaattttgataatttcacatttgtcatttgagccaagtttatttttctctaaaacagcttaaaatttctgttaaaaaacagatccccatctattctagcttatagaggttggaaaaatgtttaaaatctaaacgtgattaaaggtttgtagaaatcacaaaataaagattttggctgggcacagtggctcacacccaaagtaatcccagtactttgggaggccgaggccggctgatcacctaaggtcaagagtttgagaccagcctgggcaacatggcgaaaccctgtctatactaaaaatagaaaaattaaccggatgtggtggtgcatgcctgtactcccaactacttgggaggctgaggcatgagaatcacctgaat

SEQ ID NO: 84075 - DNA, 436 bp, Homo sapiens
ggaaatactttcctatgtgttgtgaacactacaaccctttcccacatcctcctatgcttcgtaattttgataatttcacatttgtcatttgagccaagtttatttttctctaaaacagcttaaaatttctgttaaaaaacagatccccatctattctagcttatagaggttggaaaaatgtttaaaatctaaacgtgattaaaggtttgtagaaatcacaaaataaagattttggctgggcacagtgtcacacctataatcccagcactttagaaggctgaggcaggtgggtggcttgagcccaggagttccagaccagcctggacaagggaggctggggcgggacagtcacctgagcctgggaggccgaggctgcagtgagctgtgattgtgccattgcactccagcctggacaacagagtgagatcttgtctca

SEQ ID NO: 84076 - DNA, 657 bp, Homo sapiens
ataaaatagtatataaaatacattttaaaacattcaaaactcaacattttaagaatattcaaattaggccgggcgcagtggctcacgcctgtaatcccagcactttgggaggctgaggcgggaggatcacctgaggtcaggaattcaagaccagcctggccaacatggcgaaactctgtctctactaaaaacacaaaacttagctgggcctggtggcaggcacctgtaatcccagctactcggaaggctgaagcataagaatcacttgaacgcgggatgcggaggttgcagtgagccgagatcacgccactgcactccagcctggatgacagagcaagactctgtttcaaacaaacaaaaaaaaattcaaattagaaaatggacaaaagacatcaacagacattttactgaataaaatatacagatggcgaataagcacaagaataagcacaagaaaaggtgtccaacttcatccactattagagaagcacaattaaaatcacaatgaggcccagtactttgggaggctgaggcaagtagatcgcctgaggtcaggagttcaagaccagcctggaccagcctgggcaacacggcgaaaccccacctctactaaaaacacaaaaattagccgggcatggtggtgcacacttgtaatcc

SEQ ID NO: 84077 - DNA, 393 bp, Homo sapiens
tggccttgtctgttcacagatgagactgaagattatttcccggggtgaggtgggcaaggcaagtggagggtcaacacccatgggtggctgtgagtcttccttcagtgttcccagaaaaaaaagcaaaggctcaacggatgactatactaacatctatacttctgtaagccatgccactctttaattcattccaaaaatatttattgagtgcataccatttagcaggctgccctctagtccctgaggagatatagtccagaacaagatgagcacatctcttgctgatagagaactcagtttctggcaatggacattggctctaacatcgcagccatgctaactgtgttgccttatttgcttaagcatatattcggcactatgaaaatctccacg

SEQ ID NO: 84078 - DNA, 427 bp, Homo sapiens
agacaatacagcacattccccaggatggcaacagctactggcttgtgcttaaataccatttcattctgactgaggtcatcatctttgagctcctgcaatgaggagctcaatagggtgggggatgctgtcctttgcctcaggtgctctttgggtgctttcataaaagagggtcagagccgccgatggggtctaggagaccctaagagttctgatggtcaggctgagaattgtgtcctcagggagtgggagctgctgcaggtctgagcaccaagggctccagcaccaggacaggagcctccagccacctccaccttgcagcccctgaaggtagcatatgtggaccctctagatggggtggggagtgacctctgcccagttcctttctgtcccgtggccttcccatctgcaggttgtagaggggaaacag

SEQ ID NO: 84079 - DNA, 591 bp, Homo sapiens
tcctcaggtctccctagcaatgcagaactctgagtcaactaaacctctttcctttataaattacccagtctcgagaatttcttcatagcagtgtgagaacagactaatacaacatactattgagttatcactgtatatcttatggttttatacaatttagaataatttatttttagccatgacatatgtaactataaatatgaatgtgtatttttctttgtctgtttatcattgtaactagttccagggttcttttttagggagcaacttcctttgttaaaaaaaaaaaaagcctgatacttgttttttggaagttgtggggtctctgagatcacggtttggtagtggtaagaacaaagcaaaacaaaaacagaggaaagtattaaaattttttggcacaagatactagacatttagaagagagagcagaatagtgaggctgaagcaaggtaaaactgagacatttctttttttttttttttttttttgagacggagtctcactctgtcgcccaggctggagtgcagtggcatgatcaaaatgaaacatttctgatgtcagctgaatgttctgagaaaatgaaatatttgc

SEQ ID NO: 84080 - DNA, 382 bp, Homo sapiens
tttctgttactttgtaagtgcagataagaactctattcctcacactttggggacagaacagagtaagctggggtacactgagcttggagaaggggaagtacgggtctggctaaatatttataaaatcttgattttttttcctaaggacagaagtcaaatagaatatatacactgattacaaccacttattcattcattcattttataatgaatatagaatatgaccagcaatgtgctgggcacttgatcttattcacttccacagaaaccctgggagcaaagtactgttatcttcattttacaaacaaggagatcaatgcttagagaagtgaattatcttgattgggtgctgtaagaaatcaaaatagatctatctgagtct

SEQ ID NO: 84081 - DNA, 344 bp, Homo sapiens
cacgttgaccagactggtctcaaactcctgatctcaggtaatctgccccctcggcctcccaaagtgctgggattacaggcgtgagccaccgtgcccagccacctttgtgcttcctgcagacggagctttctacttgtttctgaccacactatttactggtaaagaatccaagaaagattatgaattatttagtgttattgacttcctaaaagggtgagcagttcatcttccagagtccggtaattttctaaagtgagagggcagagtttgtgcatgtagagatgtgcatatagaatgaactttcagatgtagcggctgtaacacacactgggaccatttattac

SEQ ID NO: 84082 - DNA, 373 bp, Homo sapiens
atacagggttagaccaaagagggaattcaatgaggcctgatggatttatggaccagaacaacagaggggtcttgaaggaaggaagatatagaaaaggcaaggttgtggttagagaggaaatcccagagttttagctctgggaggtgtaataatttcaaaagaataagtccaggcctggccatgacatgggaagctgaatctctgcaatgttttttcaaatagcataatggatatctttgactcctaccctgaaaccagaaaatattaaacttgcatgtataatcatacaaatgtatgcatacctatttatacatacatttacatattttatacttatgctttcatatattctacgtgagtacaatatactcca

SEQ ID NO: 84083 - DNA, 349 bp, Homo sapiens
ctgcccttagggtttctgcaggctggtcagggagacgatgtggtaagctggagctcagctcctaaggatgtgcaggggcagttgagaggcggaagggtgggagatcattccagggtgtgggcagcacaggaacctctcttcattgggatataattgccattctgataacacgtgtttgaggtgtctaaagtaggaagttgtaccatggtgggacagatatcctgtggttatcatacacagatctcagttttcttctcattgtttgtactttttataaagggtaacaggagatataattcaataaacctttgtggtgtttgggtgtgattttattgtttctttcttctca

SEQ ID NO: 84084 - DNA, 1052 bp, Homo sapiens
caagcaactactcccctaccggcgttccgtccttgtcctcactgccaaatccactccaaagccgaggatggtgagactgtgaagttgcaaagaaacacagagcccacccccttaaagaattacgatatatttaaagtttgcctctttcaggtttctctccttggctcctgcccctttcccctcccggctccttgtccttgactgaacctcatgggacagagaacctcctgtcccccacgaggcaaggcgcgaacccgcagagatctggggtgccctttggttccctgcgctgccctggaggcgtccatagaggcctttgccgccaaggacagcaattgttttattttcgatggttgctcgccaggcctgcgggtcgcgggcccacccagccgtcgaactttccagtcgttatcagcgctgctcctaacttaatggaataatgcaaattatagcctgcccagctgacacgtccctgcgaatgcgccggggctgagctctggccagccgctctctcgacgtcctggacggccggagggaatgaagctctgaattgtgacaaaagtggggggggggcaccccaaattctcaaagcaatgttcttttttttttcttttttcttaagcaattgagccttaccaaatgtcggggccgcacggaagccttgcatattttaaagtgtaacctgagccttcgcggtttcagcttcacttaaaacatgcaaattcttgaaattgaaaaatctgaaaaacttccgaagagttctatctgaataaatccaaatccattgggagtcgctttgaggagacaaaacgcacagcgatttggggtgagggatatttgtggggaggcaggacgtgctggattgggtttccagggtcaaggtgtctctgggccttcgacgatagccttagcgcagagcagggaagtggcaccgctaggcagcaagctcagttgctctacttttgtgacccatccccccaccccccccaccgccacccttgcctccgggccactgcccctctctgcaagctttgtccgctggactccgttgc

SEQ ID NO: 84085 - DNA, 541 bp, Homo sapiens
tatgatttctaagccactcaataagaggtagcttatataatcattagaaaccatggaacactgccttgcatatcaatatttggagcctgaaggatttagtaggccttaatagtcacttctgacatttacagatagcaaacgtggatacatttgaaaattatgccaatacactacgcaaccgtgttagaggtcaccaaggaaatgttgaggaaggcagtaaaacagtggtctatttagggcactctgttattaaccatgtgggtatccaccaccatctttcctaagctcattgacacacaaagcactggcatgtttgtgtgtaagaagcttcttttgaagctgacatgactgttgaacataattagtggacaaggcaacattctctattgagttactacttggagggtagagttgttttcttttaatactttgcacttaatagtaatattgggtatgtgtatatgagtgtgtagtgtgttgaactcatgtggcatccctggggaaatttcaccatgacatttttaaaaatggaaaatgttac

SEQ ID NO: 84086 - DNA, 521 bp, Homo sapiens
atgcaatctgaaagagggagaggagaaagcagaaaaaatgaacagagtcttaaaggaatatgggaaacattaagtgtaccaacatatgcataatgagtaccaggagaagatagaaaggaaaaggaaaatcatctgaagaaattatggctaaaagtattccaaatttgatggacaacattaacctacatatccaagaaactcagtgaactccaagcaggatacatacaaaggcatccatacaaagacgcatcacagtcaaaacattaaaactgaagaaaaaaaatcttgaaaacagcaagaaaaagtcatcctatgtaagagaaacctgataaggttaagagctaacttctcaccagcaacaagaaggccagtgagatgacatattctaaatgcagtgagatgacatattcaaactgctcaaagaaaaaaaaatctgtcaactaaacattgttttttcttttgaaacagggtctggctctgtcaccctggctgtatagcaatgtatcgatctatactcactg

SEQ ID NO: 84087 - DNA, 287 bp, Homo sapiens
tgttgttgctgtttttcacataacgtataagccaaataccaattgttattacttatggattgattagtttcattttcatctggatttcttactatcttgaaatttcttcacttcctaaactcttaggacaaatgacttaagtccatttaaacttatcataaacaaatgtaaaataaactatttttggaatttgctttttgttctcctacacccgactctacaatcaatgttattttaaagtatatattttgtataaagtggagagtacactactatttttttaattg

SEQ ID NO: 84088 - DNA, 227 bp, Homo sapiens
gtgaaaccagtgttactgattggtaagaggaggttgaggaaaatttcttaggcatgtatatatgtgaaccaaaatgttacttaatgcaaatacataagagagtaaaacaaaacaaaaacaactggaaggaatatacaaaatccaaaataggaagagctaccatacatttttaaatttaaataagaagaatttaaatacagtagagcataaaatctgaagttgggagc

SEQ ID NO: 84089 - DNA, 702 bp, Homo sapiens
ttcatgaggacaggggctgacctagtctctcttcttcacctctgcagctctaagacttagaatcatttaataaatatttatgggataaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaagaacatatcaaaatttgagcccgccctagcgagagcacctcgagcttccgcatgacacctcatgcatcatgagcgatcttgctcaccttcaacctagtgaggcagttctcacattgtatccctgggccgatgtagtactactctagaaatactgcgcgccaggccatcacagacaggcacgtatgcatgacagtggtacatgtgtcacatcacacactccagtatgttgctcgagcaggatagtgaatactttgccatcagaagtgctcttcaatgaaagggtacttatacaggacatccatgcatgggcaatgaaaacaaaacgactgcggcgtatcaatatacttgatgccctacgagcaacctgcactattattacatgaaccaagattgaaatagaacctgacatggaacgtcacattcagaaagattgccaatgaaactatcgtttgataccctggactacgtaattattatatacctaaccaagcgttagagaaaataaatgcaaaggaaa

SEQ ID NO: 84090 - DNA, 804 bp, Homo sapiens
gaaaaagaatccatttgtaatacaatgccctattactctccacttgtagaaagaaagatgcaaagttcagttagtaaaagagtattttgttttctcaataaaaataatctgaattttctaagaaatttcaagttttactattaaccaatccactatgtgatgtccagaatttgtacagacagacctttcctgctgttattttccttatattttctaattagttcctggtaaaaaaaactctttgtcgtgcagatagtttacctgctttagctcactcaggatgacctccaaggtcctcatctggaggtctacttagtgtcctacctgtgtttttgtttttctctttttaaagcctgtccttcatgaaatgcacttccctttttgttctttcttgtccaaaacctatctgtttttaaggtccagctcagatttacttccttcgtgaagtcatttcagtgtattttgtttagcttgtatttggtgtttagttacttaaagctgttaaaataaacaaaacttataatagcttcatctccccaacttgtaagcatagttacagacagagttgtcatttttcatgttcttgtagcacatagtagatacttaagtatttttaatttggtggcatattttatgttttgattattaaattttctgtgtttaattatgaaacactgtaggaaaactcccataaagctgtacagttggggaagattgtgctagaatgaaaaaataaactaaaacattttacttacctagcttgaaatttcacttcatagcacaaatactgagtctgttatttta

SEQ ID NO: 84091 - DNA, 920 bp, Homo sapiens
gagactctgggtagggcccagcaactgcacatctcacactcttgccaaagtgtgagaacccctggaataaagaaatgtcaatggtgaaaaaaaaaaaaaaaaaaaaaaaaaaaaaaaaaaaaaaaaaaaaaaaaaaaaaaaaaaaaaaaaaaaaaaaaaaaaataagaaaaaaaaaaacagaaaacaagacaagatactacaacacaagtatgaaacaaagacgtaaagcaagcgacagcaccatactaacggcgaactagctcggaagagtcgcgaccgacccttaccacacaacacaacaaacacaccacaaacaaacacaaccacaacaacagacatcacacagagcgcaccagcacacaccagcaccgagcagcagcagagcagaaccacgagcaccacgacacacaacacaacacgcgcgcacgacaacacacacagagacacacaaagcaacatacaagagcaccacaagacgaagcgcacaaaaccaagaacggacagaaagccataccacagaaagacccagagactcacacaaacgaacaatcaaaccaacacggcgcgcgacacgaagcgcaagacctgtcaaaatcagaaagcagcagaagaataagaaagaagggagacatgggtcgcagactgcgactgatatatcgtatcatatgacgtatatatgctaggcaaaggtagaggagtgataagttaagaagaagtatgagtggacagaaagcagcgacagcaggtaacgtcatggcgctaggccggaatgagcgtcgagcacaagaggataggatttaggtatacgtggagatggaagggaggaggagaaggaagaagagaacagagtagatgaagaaaatggaagtagagaagcggagagagatagggatgtgaagaagagaagagaggagagcgc

SEQ ID NO: 84092 - DNA, 98 bp, Homo sapiens
ttcccacctatgagtgagaatatgctgtgtttggttttacccttttaaaattttgaaccatgttaattatattttttaaataaattttttaaatgaaa

SEQ ID NO: 84093 - DNA, 767 bp, Homo sapiens
aggttcagggttctttcttgggtatatgacagtgagattgtcaacgttttttagggcacactgcctcctcctaacagaaatatcgccttaccctttgtgattaatggtacaatcataatagatatgatgaatccaaacgtggtgagggggaggtctttatatctttttcatatcttttttgtttgttttcttgtagcttatgatctgatgtgtgtcttgtcatatacagaaaaaaaaatattttgggtggtattttcaaaaatttgtttagattttatatgattctaatgaaaatatttgttttatatttaatgtcagtaattgtggtttctattaaagaatatcaatttaacaataattcatcaatatatacttagaaaatagtttaaaaagcaatgatctgaataaatatattcgttcgttataatggtgtattctttcttttttaatacaacttgattactttaataccaatcacattgcctttgctctggacattctgttttattaaaactaagataagaccaagattgtttgctaaaattgccaaattattttgaatttcagtggaattgattagaagtacagattgttggtattataatttttcatgttaggattgtgtgtttttaatgaatattctaggtaactttctcatcagacagttttaggaaacagtggtttaaagaatatacatgcaaacaattagagtgaagttataaccaaatgaaattgtcattagccaataaaaagcgctttaacccatt

SEQ ID NO: 84094 - DNA, 512 bp, Homo sapiens
agtggacaacaaatccacagcccaaaatgtggaaggcattatcgtcagcgccatgtttaaatccctcatcacacgctgcgcttcaaccacacatgaattgcacagccctgagaatctggtgagaagctctcctctcttcccacaggagctctcagtctctgccctgagaaaagtactcattgtcgtggccatgagtaagagaagctgaaatctaaaagtctacactttaaagtttaaatatctattttccccggtgtcaccagtaagtcataatggagccttaacaacacttttcttctccttgttactcattatcctatttgcaaattcagctatcttcctctcccatctcaaaggttatagagtgtttggtgaaataattgtaaagtatgctgagcccttcagaaagtttctagagcacagcttgttggctcgtaaaatactaaagaatgttatcccaagtattatttgaagccatatttactttaaaaattaatgcaaatatgttgctg

SEQ ID NO: 84095 - DNA, 254 bp, Homo sapiens
atattgcccaggctggtcttgaactcctgggctgaagggatcctcctgcctcagcctcccaaagtgctaggattacacgcatgagccaccatgccaagcctgtggttagttttagtgtctaaattttcagtgggaatataagtttaaaggcagaaataactgaacctatcactaagttggaggcagtttttgctattgtgtattcggagtttctttttattacatgatataatttaataagcttctttacctaa

SEQ ID NO: 84096 - DNA, 435 bp, Homo sapiens
atggttaatggtttctgcagaaaaggaccaattgatttctttctaaaacgttgcttcagggtgtagagacctttataggtcatgtttcaacttacagaaaatttttatagttcaaatataaattaagttcaatgtggaatttgtaatataatttcaggtgaagtaaaatttccacttaggctgtttgcagtgcccagcaggccccatgatatcgagatggaagttctgttaaaggaggagattgatcagggatgggcagaataaggaatatgggcagctcaggctaatgatacaatgattgagatgtagaaagagggtcaggcacgggataacgcctgtaatcccactgccttgggaggccaagacaagagaatcgattgaggtcagaccagcctggtcaacagagtgagacctaacctgtacaaaaaaaaaaaa

SEQ ID NO: 84097 - DNA, 422 bp, Homo sapiens
tgggcactgctgcagccatgggcactttgagagtttcaggcactgtttgagctccaggtactgactgatctgtcagccccccttgagccacgggcttcccttgccctgttggcagcactggagcgggtccctcttccagtcccttaaaatctaactgcatactcccttgatcccccggctcacctccagcctgtagttggggtgtagaggtcaagggtggccctatctgtgggagatccgagctaactttgtcttttacatctgagctcccagggaccaccaataaactcgtaacttttgggagtggggactggccaaagcgctccaggccgcaggcgccgagtgccaggtggccattaggtgggagtgtatgggaagcaggagagggaaagggatgacaggggagctggttgggtgaatag

SEQ ID NO: 84098 - DNA, 341 bp, Homo sapiens
atcctcccacctttgcctcccaaagaaaaatcagtcttttgttatgtcttcattttattcacatgcatgcttgattcatgttctgttgcttctattgattattaaatctggtttcagagtactagacagactgtcttgctgtgttgcattctactgttttgaccacgaaaggacaggttaaatattgtgttctgttacaaaatgaaatggaaaactaggatcattcacaaaatatttgatgtactatggctcattcttttcatggttgtctttgtatttcagaaatgcttctttactgtttgaatgaccatatatggaaaatagacaccgtacaaactctt

SEQ ID NO: 84099 - DNA, 249 bp, Homo sapiens
atggagcataatggaatcacaagataccatgcagccacctgaggctacgggctgtggataaagtgtgaagtgtccctacacctagatctggaagggtcagaagaaggagcagttcctgggcctgaacaaaaaatggtgtggagaaggtcactgggagaggcacactgaccctagatgaaaggacatgtccaacccagggccacctcacagggaggagaccagaagactacacaccttctctctctctct

SEQ ID NO: 84100 - DNA, 995 bp, Homo sapiens
taacttctttccaagcgtccgcttgtacatacgttgaacgtggttctccgttcccaccttcgccctgccagcctagagggaccgcgctgccgtccctttccttgccttttttaacttcccctccccgttttaaaatcggtcttattttcgaagtatttataattattatgcttggtgattagaaaagaaaaccttggaggaagccccttctttccccagccggggtccgccctcagtcgcgagtcacagcatgagtcgctcgccaggaggggcccggcccctgcctgccccctccccgcttgcccccgaccctgctaccggcgttccttggaggtcgaagccagggacgtcacccgtgctgtgtccaggcctgctgtcctactatgctcaaccgggggtgggggaggggggtgagtcctgtgctcagtcgggtgggggctggcccggatcccgagctgctgtctctctatgcaccagaacatatctgtaactcctggggaaatacatcttgttttaaccttcaagagaagtgaaagaaaaaagtaatgcacagtatttctagcagaaaatttttttttttaagaggaggcttgggccagagccttctggcatggggcgggtggagaaagtgtttttattttaatttaaattgtgtttcgttttgtttgtggaatctttctttaatgcttcgtcgctctttggactagccgggagagagggcgaggaggcgggtgctccgggccctgtaggctgggccaggcgcctgggggatctgcccgttttcggaggccctcaggggccatcagtgggattccagccgctccacacccctcccctgagcactcggagtggaaggcgcgccgactcgttgaaagttttgttgtgtagttggttttcgttgagttcttttttcatttgctacgaaactgagaaaaagaaaaaaatacacaaaataaatctgttcagatccacccattattctcctactttcttta

SEQ ID NO: 84101 - DNA, 836 bp, Homo sapiens
  misc_feature (41)..(41): n is a, c, g, or t
tatgtcgtgtggaaacaaagttagagctaaaatccgtagangaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcctgagtgtctgctcactccccttccaccctcagcggatgataatctcaagacacctcccgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcatcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccacc

SEQ ID NO: 84102 - DNA, 355 bp, Homo sapiens
gattttcatctccatcactaagtattgtggatactatagtcagtgtgtcttgtagtgatcttctttcacatatggggaaatgggctacagtcccaaaggaagtgtgatttaatgtggggagaatgatatgtgataaggtgagtgttgcttcaacgccctttttagagactgcagaggtttcatttattctctcagtatcatctgtctagatactccttccttttccaagtctggtttaaggctgggatgagtacttctcaaactttaatggtcatcagaattacttggggcagggctttttaacctctttgatattgacatgttgggctggataattctttgttgtgggaggctg

SEQ ID NO: 84103 - DNA, 330 bp, Homo sapiens
acttccttcctcaggctcctgtaccaatcttcaattcacttgggatgtcctagtctaaaacatttatttcatttgaaaggaaaaatatcaatttctatctaaattggagtaagattccattcagatgtgttatttacaaaacataagttgttatttatctgtgtttaattgatcctggaacattccatgtaaagaacattccatgtaaagaaccaggcaacttggccaggcatggtggctcacacctgtaaccccagcactttgggaggccaaggcaggtgaattggttgagaccaggagttcaagaccagcctgggcaatatggcgaaa

SEQ ID NO: 84104 - DNA, 523 bp, Homo sapiens
tattaggtctggtgtaagtcaaaccttgccactatctctactggaagaaagggaacacttaaaactgactccccctcacttcaattttctctgtttttactaatctgttttcactcaaaaatcaaaggtcactaatgatgttttcagtcatgaattgaatagtcaatgtgattaatttctagaatttacaaacttgtgtgcttcagtattcttaacatgagtattattttaacgaacaatttaagacaatgctcctggccacctgttcatgtttcctctattacgtctaggtaataaaggaattcctctcagatgattctaatttcaaggatgaagttcctacatttaaaaacacgaaacacaaagataaaacatatgctacttagtaaaaacaaacattaaagaatgctcatataattttatatgaaagactccatacttaaaatcgtagcagtgggcttttaacctgaccataataagtggcaaatttctcaaaagaatgagaagggttgcgaaaaattta

SEQ ID NO: 84105 - DNA, 408 bp, Homo sapiens
taattcttagtttgggccttttcaggtagttttctacatcttatgggcaatcttcatggcttttcatcattttttatttaacttggcaaatataatgtcttaaaaggcatctcttcttgaaagtttctaattgccgtgcactactatgaagacatttggataggattatttcagagacataatttctgtgtgattagggttttttgtctattttatcaagattttaatttctagcagtgggataattatattaataagttcttgggaaatttgtggcgcttagagtctgttgaggtgctgaacagagctgggggtcttgctgtagccagtgatctcaggacattttaaacgctgccactgttgtaggccaaaaccagtgtgccttatatcagtgaagactctgaagcc

SEQ ID NO: 84106 - DNA, 356 bp, Homo sapiens
tctcattttcctgtgggccacaggccggctgcaccccaaagtcttgctggaacagcaggcccctccctgcccctgtggtcctgcagcagcaaggggccctgactctgaggccacagacctgcatccaggagatctggtcagggcaggcggctgccagcgatgggctggaagcaggccactggcctcaggcagcaggcccagcaaagatggaggcgggaggttggcagcagccctgcctgtggatgccacacatgggggaccccaaaactgtttttaaaaacttgggcctttacaaggccgggcgtggtagctcatgcctgtaatcccagcactttgggaggctgaggcaggcggat

SEQ ID NO: 84107 - DNA, 713 bp, Homo sapiens
ctattttgaattagagtaataaggaagaatggtatttatggtccttaatttttctgatcatgtcattttggcctctgcttgtttttgtccagatgccaaggttcaaattcaaggctctagtcctttttaaaaatgcctcttcccggccaggcatttttaaaatcccagcactttgggaggccaaggcgggtggatcatgaggtcaggagatggaaaccatcctggctaacacggtgaaaccccgtctctactaaaaatacaaaaaattagccgggcgtggtggccggcgcctataatcccagctactcgggaagctgaggcaggagaatggcgtgaacccgggaggcggagcttgcagtgagccgagatcgcgccactgcactccagcctgggcgacagagcgagactccgtctcaaaaaaaagcctcttccccgaaactatgtgtatatacattgcagcatctttgatggcaaactatatatttttaaaagttgcatattttaaatacaattaattgatctaagtataattgtaatcaatattttcgactgagtcttttctctgtgcaaagaaatttaaattcatcagagtccctctcaaagtgttctgttatgcatctctttatgagctcatttgcatacattatctcatttaatttccttaacaaccttgtgaactaagcagggcagatattatcattgactgaatgaga

SEQ ID NO: 84108 - DNA, 958 bp, Homo sapiens
gaaagagcattccatcatgacccttggactgggtgagagcatcatcctttaattaatgtctgcgctgggtcagataaccatcactgtctccaggtgctggaatacagagaggaaccaaacagataaaaatccttgcctgcacggagcttaccttcagctaagggagacagtcaaaaacaagtcaacacatctaaagaagccactgatgaaacaggctcccccttggaaagaccatctcaccttccaacctctccatcctgcagagaggaaaacccaagtttggcgttggcagtcaggtaattcatcagatctggaaaccacctcatcagcatccccctggccaactggaagcaaccgtgacgttgtgctgaatacacttgcagagtcgtgctgtggtctctccgagctcatcacggcacctccctatgcaggagtttcaattcaaggatttagccaaatttgggtgctatttcccttttgtggagggacttttcatcacaatgagaaggacgtcttaggactccaggactttgagaggcttgcccatggctgagcatgaaccaatcagcacacacttccctgcttctgagcccattaaaacgctggactcagccagactcagacagaagtcaggactaacagctgtgggaaggagctacccacttccggtatccttgactcttcaggattacctgcctgcaggtacgagctacccaccatgggtctcctctccactgagagctggacacttgccaggacgacctgtctgtggaaaggagttacccactttgtgtctcctgagagctcctctgttactcagtgaagctcctctccaccttgctcgccctccagttgtccaggcattccattcttcctggacgcaagacaaaaacttgggacctgccaaatggtggggctgaaggagctataatacaaacaggggtaaaacacaaacccc

SEQ ID NO: 84109 - DNA, 233 bp, Homo sapiens
taaatcttctaatatctatgggttctttgatattgttcccattttcattcctgattttgataatttgtgtcttctctcttttttccttattcatcatgaacttttatcaattttgttgatcttctccaagaatcaagattagttttaagtattattttttctatatatttgtgttttcaattttactcgtttattttttgttctttattattttcttcctcctacttattttg

SEQ ID NO: 84110 - DNA, 131 bp, Homo sapiens
ccatgtagctctggagttttatcagtgttttatttatttgccaatatgagaggaaagaaatagtgttatttaatttcttaaattgagcaattttgtatcttaatagaccataaatatttctcttattgtct

SEQ ID NO: 84111 - DNA, 643 bp, Homo sapiens
acttatttacctggcatttccttgaagtcagcacttgtgcttcatttatctttgtattttcaagtacttagttcaagactttccagaaaatgagcttgtcttagtccatgcaggctgctataacaaaaaccaaagactgggtggcagaaacaatgaatatttatttctcacagttccgcaagctgagaagtcctagatcagggtgccagcaaattgtgtctaatgaatgtctgcttcctagttcataaacagctatctttgcactgtgtcctcaacagggcagaagagggccagggagctcttggggtctcttttataaagggcactaatcccattcatgaagattctactcttatgacctaattaccttccaaaggccccacctcctaataccatcacattgggggttaggatttcaacatacgaattttgaggggggggacaggaacattcagtacataacagaggtttaaaaaaataatcaaatgaattaataattcttctttttaaaagttacagtgtttaatttcaatcttaggtttattaataacatttatttttcattaacttgtattataaattacaaaaactttgttgtaataattgtcatttatttaaatgccaggtaacggggtaccttgct

SEQ ID NO: 84112 - DNA, 766 bp, Homo sapiens
ccttgcctgccccatcggagccgccggaggtggagtccgccccccggacccccgaactcctgtgcgtgcccctccatggtgctctaggctgtggagggcaaggccagtccccgggagcagggtgaggaaggggcccccacgcagccctgctgtggattggcgggaggaccccaggctgggccaacccagcagcccgcggccaggagcgggcatcccaatggggaaatcggccaggaggggctggggaagctggtgccttcgcccgcgccccgtgagctttacctccgtgcgacaagagcggtggctccgggcggggcccacgcagctggagcctccatctctcctgcgggaccagagcaccgggaagacctgaccgagacccaacgtccctgcccccgttctggggctctctgcaggccccaacttctgcgggactctccagtgggagcagcaagggttctcaggaacaacccctatacaaaccgggacagaggcacctcactactccttctgtgccccaccttctccactgaccctgccggagtgcagcacacacagcaagcatttaataaatcgcttgaagtggggaacatctgtactcggtaaagaaaccacaggaattgggaactgccggttgaagattatttaccagttccagcaaaattgactgcacctgccatactgcaggccggtgcagcatcaggagctggagaccaggggcaacaggcagcacgcgtgctccagctcagagtggaaggccctggga

SEQ ID NO: 84113 - DNA, 906 bp, Homo sapiens
tctaaggctaatgaaaagtgtttttaatatagttccattcaaatacaattagatgttagaaatatcttttcatcgaaagctaaccaaaaatgtgttagaaatcattgcttttttctgaaaaagattctaaggcacatgtcctcatccattcctatgtcaggattctcaccaaagagcattagcctgggatgacgtttcctgagcttcctggggggatgccttttgaatcgggacttaatagcgggcccttggtcttaccattgaagtctttctgcatcttctgcagaccgaaggccatgtcgcctgattttattcattaccacccttgtaaaggaaaggactgctcttgaagagcttttccttccttttattggacaagaactgtgtgcctcagctctgagctcccgctgctttagtcaacagcactgtagcaaaagcacaagtatagcctttatctcattcactgtcctcatcattttcttttccgtagttctgtatggtcccaccatcattcattctataaagatttgtcagccactctctgcctgtcagatattgccacaaagtaatatccttttgtgactgtatttattggaaactatagtgcattcttgttgtcttctaaaccttcttaaatctgtcgaacagtaagaatgtaagccattgcaataagtaaggcatggtagaattcctagttaacaaagatacatgaaaatgtgtatactactcttcgtgtataagtaaactaattttttaggaagattttcaatgtcaaaagttaaagctggccaggcacagtggttcatgccttaaatccttatgcttcgggaggccaaggcagaagaatggcttgaggccaggagattaagaccagcctggaaaacgtagcaagacactatctcctta

SEQ ID NO: 84114 - DNA, 178 bp, Homo sapiens
gacgcgagggcgaggcggccacgcggggccgggaatgcccgcggtgcggggccccagagccgcccggtggtcgtgtccgggcgatggctcttcgcctggtcgccgacttcgacctcgggaaggacgtgctcccgtggttgcgggcgcagcgggcagtgtcggaggccagcggggccgg

SEQ ID NO: 84115 - DNA, 509 bp, Homo sapiens
aaggagagagaacaaacaaatgattttagaaggacagcacattacgggtgccctaccggattcaggctcctaatgaagaagacatgtttaggggaactgaagaattgtggattcagtcatttgccatttaccttgaaagacacgtccagataaatgattacatcttcagaaacttgaagcgtttccttcattctcgactatgggtacctagatagggttatgaacgtgaaaggcagaaactgttttgcccatactgcccttccatccaaagccatgaccctctgtctaggtggcactggctacagggaacagaaaacagatgcctgcaactgagaagcctactgccaactacaagctgtttgtaaacacttctctccatgtttacctaagaaagatgcaggctttccaaggaaagcctccttttgaaaaatgtgcctttttatttctctgtgctgttaggtccctaaaataaaaactaatgcccataattctttataagtctcccatct

SEQ ID NO: 84116 - DNA, 642 bp, Homo sapiens
tccggtagagcgccctggagaggccctggataggcacaggcgcctgtcagggggctcttcacatgctgtgtgctgctgctgggagaagagggggccagagactagggggcttctaagaagaggtggcatttctgcctcagtgttgaaggatgaataactttgacaggctggaaaaaggtgacatttcaggtagagcgtgtcacatggatgtaaataccaaaggtcaaggacatgggcttgagagatggtgagaaggatggaggtgactgtggcttgcattctatccgtatcactattaattaccttctaaatgcctttggctctaggtggtggaacaagtaaagtaatggacaaatactttttctaccaatatttagtgaccaaatgcagagttatggagagggccagggacctcatgaaccatactctttctagtctagggacataactccaatgcctttcctgtcccagtaagaggccatggatttcaagaagccagacaatccattctttcagataatgataaaaaagaaaccatttattttatttctaagtatagaatgaaacatttatagttgcccaaattttggtaccttttaggagaaaaatacagatttttttgttgttaaaaataaacttaaa

SEQ ID NO: 84117 - DNA, 261 bp, Homo sapiens
ttcccgggagccatgcttgtgcctgcatctggaccttgcctttttcctgtttatggctcgctgcctggatgaatcttgaccttgctttttcccgtttatctttcacgtgtgtttttaggcagcaaaggtttattttctggcacttttcggtgtgaaatctgaagggaaacttatgcaacaacttagcttactttgctttgttgcttttttgattccccaggcagagagggtctccttaacaaagctaagatatatttaata

SEQ ID NO: 84118 - DNA, 792 bp, Homo sapiens
tatggcatacactaactctgaaagttcagtaatgatgttttaaaatgttactttttgtgaagtaagggaaaagcaattttaggtaatcattggcttttaaaaaccgaaatgtcattgacaaccgggattagaatagaagtatccccaaactggaggaatcccctccccatccaggtcacatagccaatctctcaggaacccctcttactgcaaaacccagcctctactcaaacagttccggtgatggggagcatttattccataacagtggttttttgttttttttttccccagtgtctcttttaaagaaaacatactttattttggtctaaattgtgaaaatacccaaaacatttgatagaaattgaactctgtcaacagtgttatttatactaagatcaggacagttccttgagatcatactgttttattactaagtttggcctttgttttacaaatgtaatgttcatatttatttgaattttaagattggttaaatgttaatgaaaagcaatccaattgttaatttttagtagtgccttttctctgtatgccttaattttattttatattaataattcaagttacccaccaaaatgaagattttttccaaaatcagtaggcttcacaagttcatttggccttagactgtgtattggtccttaaatgtttcttaatgcctgcctcctcctacccttttctacctcctttttaaaaaaataaataaataaataaataaatgttaggagagaaacattaggatttgtctgtgatagacatgctgcagcttcc

SEQ ID NO: 84119 - DNA, 580 bp, Homo sapiens
atacccttacatatatattcacagaaaatcatattgcatatactctttctccacatcataaaaatgggtgttgggctctctaggacacaagggaagcaggccaaatttctcatattttcaggaataaactgagtgccccgaaggtgtaataggaaccttttactaacctcatctgacttcatcctcacaccagcattttgtgtgtaaggaaactggccgagagtggttaagaaacatatccaaagacgtatagttccaaatggaacacggatctttttatttaaattccaatcatctttccattatatcagccaatgatggagcagaaagctggtccaggcaatcccagaatagatctttctaggcacccgttcagtgtgaggaggggaagtggccttgccaaggggccagtgagctcaattaggttaaacgctgcttcttagccctaccccaagaggacaccgtcactaagattgttttgtgcccagccttggacaggaaagcaattccctcctttcacagcattctcagccttgacgttcaataataatcgtgatgataatagtggctttcttttatt

SEQ ID NO: 84120 - DNA, 890 bp, Homo sapiens
gagataccatgatcacgaaggtggtttttctcagggcgaagcttatccattgcgttccggatgtgctgacccctgcgatttccccaagtgtgggaaactcgagtgcataatttgtgatagtagggaactacgttcgcgctttctcttggtgcttctgtggtgcgaatagtaggtgagccgtaagtgtttttgtaattcagggtgcgggctcgtgttttgtggctgtgttctgtccggtcagttgtttccgttcgcaacggttagttttcctttgtgaggccatgtttggggacagcttagaactatccacttgctctcttgggaggcgaatttcagtctctgttggttgggttgttctcccaggttagctgccgcggtacttgctaggtggagctcagggatcaagggtcgggagctttctggtttgttcagtgctcccagggcttctaacatctcttaaaaactctggtgttttctgtcatcctcggagttacctcttagcctctgtttttttgttgttgttttttccccccctccctaagacaagtctcgctgtaccgtccaggctggagaagtggcgcgatcttcccatctcaggctcccgagtaggacaaccgcacgccaccacacccggctagttttttctctttttttttttttcttttcttttctttctcttcctttccttttttcgtagcggtttcaccattctgctcaggctgggctccaactcctgggctcaagtggtccgcccagccttctgaagtgctgggattacaggtgcgatccatcttgccctggcagctcctgcttttcaccacagcattcacgggagtttgtaggatttctgtgctggggaaacgtgtactcagttaatagagccaggtgga

SEQ ID NO: 84121 - DNA, 874 bp, Homo sapiens
gagataccatgatcacgaaggtggtttttctcagggcgaagcttatccattgcgttccggatgtgctgacccctgcgatttccccaagtgtgggaaactcgagtgcataatttgtgatagtagggaactacgttcgcgctttctcttggtgcttctgtggtgcgaatagtaggctcttcaaaggactaaaagctaaaaggatggattcattcgacaagtcctagtcctgcgccctggtgagtgccagaccctgctccccgtgagggggacccacgagccaccctcaccacgatccctgccctggtggagcccccgtgcggaacacaggatccgaagatggcagcggaagctccgcagcggcccaaaagcgactgggcagggagggcacaggctccctcactgggtgaaggcggcgcaaagaatgggaagagccatcccgggagccaccgggcgttcagcctccctagggcccccaggcggctcgggccggggtctcaaccggggcgtttccgggggtttctgaagcaggcgaggggcagggcgggcgaaggccattcggctatccttctggctccagaatctcccaacgcgcaggtgtccaacgtgaccagcgcgacttaccgctccaatctctccagttttccaaggccttgctcagtcctcctgccgggcgggccctgaggatgcaagggacggaggaagtttcgtgcgtgcgcccttcctatagcgcccagtagaactaacagtacctgtctctgtggcgcaatcggttagcgcgttcggctgttaaccgaaaggttggtggttcgagcccacccagggacgcctctttgagcttttaaagtattcatgcattgtcaatcactagataaat

SEQ ID NO: 84122 - DNA, 501 bp, Homo sapiens
tgtaaatagcgctgcaatgaacattcacggcataaaaaggaatgagagcatgtcttttgcaggagcatggatggagctggaggttatcatccttagcaaactaacacaagaacagaaaaccaaataccgcaagttctcacttataagtgggcactaaatgatgagaacacatggacacaaagagaggaacaacacacactggggcctatcggagaatggaggttgggaggagggagaggaggaaaaaactctattgggtactaggctttgtacctgagtgatgaaataatctgtacaataaaccctcgtgacatgagtttatctgtataacctacacatgtaatcctgaacctaaaataaaagttatttttgttttgttttggttttttaaaaaacctgcttgtaacaaaggctgtaggaagctcacagccaagggtatctgggacagagtctttcaggcagttgtcctcgttttggttcaagtaaactctttaaattata

SEQ ID NO: 84123 - DNA, 305 bp, Homo sapiens
  misc_feature (130)..(130): n is a, c, g, or t
  misc_feature (135)..(135): n is a, c, g, or t
atcgcaggtgggggaggggagggctgggggagtgggagtgcttacatagtagaatactggtgccagcgggttcccaaacaccaggccggggtcagacgagcaactatccccagaccaggcagccccatcnggtangattcactcatctccctttctgtgaacgtgttgtctttcctgctcacctctgccccgagggacggggagggtaattatctgccgtggtgtcagaacttttatttcttgctgctgctgggcttccgccacagggagagtaagacggaacagagataccagaagaaaacatc

SEQ ID NO: 84124 - DNA, 753 bp, Homo sapiens
cttggagaggtgtctaaatgttgctccccaaatgacatattgtgcctcaacaacaaacactgacaaaccattataatcacaaatgggacaactgaattgtcagggctccttgtagggttgaaatttcctcagagctaatcagcctacagaattataactaggtccacaaggaaattacggtattttttccatgtagtcagatctggaagaaaacaaaaatctgacggaagtctgtggccagccaagtctgagcagagctaccttcattacttggggaaattcctggggaaggaaagaaggtggaatcagtgctgtcagtggacctgaagaatccttctgcgctgtgtgttttctattcctattttattaatgcggaatccttgttgatacaacctggaaaatatatcctaataccctatcagctcttccattcttgtcatgtagtgggtgaggggatatgatctggacactacagatatttaatcacttagagctattgtgtgatgctagagcaacagtaccaaagtgtccttgtccttaaaggcccccaacccagccatgagaggacaagcagagaagtcactgctgctgtggtcaaccaattatattggggacagaggagggaacaattctgccagctggagaaggcatgctggagccatgacttctcaattgggccttgaaaatgactagcttttgccaagggatgaaagaggggaatggcagtcctggcagagacgagtgtgggcaaag

SEQ ID NO: 84125 - DNA, 1544 bp, Homo sapiens
gtatccctgccagatttccccaagacctggactcttctagtttttctcttgttttggatatgaagaatcccaagaataaccaatgctatatattacctgaaagtcccacctctgttctgcatttctaaggctgtattttatcttgtttgccctatctgatctggatctatactttatctgctcttatccttagggttgtagtcctggagtgttggtccctcttccttgcacaggttacaaatttaccactgccacacagtgttcttgttgacttcctcagaattcctcatcggtaggggtttagttcccatcttaaccaggatgtcagatggctgccaggaatgtattcaaattctgcacagtttttcagttgataacaaacaggcccacagatcttctagacaaatggtttgtaaactctccctcaagaaacctttgcggttctatagtgaagggaaatgtaggaagtagaggccgaataaatggagttcttggttgcccattttccctctttaactagagcagctccagttttatttgatctgtttatatttctgcgtgtgatttttttgaacaaaggtaaagctattaaaaaatctttgaaaaccatctgtccagaccaaagtttctcatattgttttcaatatttttgttttaaaaattcctctatgaccaaataagcttgagaagaaactatttaaaggaaattaaatgtattttcactggagaacttcttagaacctttaatatactagactatattactaaccttcaagaagaataggcatgtaaataaagcatttcccaaactttcttggtcttggaggtctttttttcagacattctcataagactaatattctttaaaacttcactttatggataaggaaactgatacccaaacaactatgggatttgagtttcctattagacagtccagggacttttttattacaccacactttctctaagacttttgtgctgcttgctaattttactcctatagtaaaattgtgagagatatttttttctgtctttgaatgaagaattttttttctgtcaccatagaaattatattacctatctaataattgcccatattacatataaaatcttcatccctttaaggtttagcatttagttctctttattatagtggatctttattgttcatttatgtatgaaacctgtgctagggattatagaagatacaaatttgaataaaatatttgatctaggagctcttatctaaaatgccataaccatttgcttaattataaaatgaaagaaggctataaaatgatacatagtaaaaattttaacagctatgagagtttaaaggaaaaggatacaaattatgactgcattgaaaaatagcactttgaagctgagcatggtgatgcatgcctttagtcccagctactcaggaggctgagatgggaggactacttgagcctgggaggtcgaggctgtagtgaggcatgattgcaccactgcagtccaacctaggcaacagagtaaggccctacctcaaaaaaaaaaaa

SEQ ID NO: 84126 - DNA, 178 bp, Homo sapiens
ctcaggctcacagggaaatactggatattcttcgagttaataaagtgtgaaatgattttaattattcaagggaaatatagtataccagtcttgcaaatggtttttttagacagcatggtctgtcttatcccatcctacatcagaaaatttaattggcttagttatttcctctttccca

SEQ ID NO: 84127 - DNA, 596 bp, Homo sapiens
gcgaattcactagatgattatccccggctcctgggtacaagtaaccgtcctgcctcggcctcctgagtagctgggatcacaggtccgcaccaccacacccggctgatttttgtatttttagtagagatggggtttcaccatgttggccaggatggtctcgatctcctgacatcgtgatctgcccatctcagcctcccaaagtgctaggattacaggcttgagccaccacacccggccagccttccctattattaatatgactatggttcatttgtgatacctagtgaattgatagtgatacattagttactaaagttcatacttgaggtttctttagtttttgtgtatgttctttttctgttccaggatttcatccaggatatgttattacatttagttgtcatgtttccttagggccctctagactgataaaatttcttagacttttcctttttcttaatgatcctaaaggtacttttgataaacagaaattcctaattttaatgtatttagatgtatcagtcttttaccttctgttgttagcctttgtttgttgtatttagtctttatctaccccaaggtcagaaaaaaatata

SEQ ID NO: 84128 - DNA, 652 bp, Homo sapiens
atcatatacaaatgtattctctgagaatgagaaaaagcagaaagtcaaaaaaggaattttcccagccattcgttctccatgtaggctttcgggaagtcctttttacaaacttctgcttatatatgattacccagaacttaccacatgaccaaatttagctgcaaaggcatctggaaaatgtagtcttttaaatgggcacattgcccccacttcttaataacatagaactgcagttctcaaccttttcggtcttgaaaaaggttgatacctcttataccctaaaaaattgttgaggaccccaaagagcttttatttatgtgagtaatatctattagtatttgccatattagaaattaaagccaaaaaatctgaaaatatttgtttattcatttaaaaagtatatttatatgccctttacatgttaaataacatatgctttccaaggaaaaaaaataaagtgaaaagagtgatattgtttgacatttttgcaaatttattcagtgtttgacttaataggagacagccagactcttttatatctgcttctacactgactctgttacaatacgacatcttgcttgaattatatggagaaaatctggactcatgcagatatgtaactgaaaaatataaaagtgtttttaaaactttt

SEQ ID NO: 84129 - DNA, 536 bp, Homo sapiens
ttaatgttcaccttccatgtattaatttatgtcttcgcttataattcctatctccctaaaatgtataaaattaaactataacttgactacctcgggcactttctcaggacctcttgagactgtacctgagccatggttattcatattggctcagaataaacctctttaaatattttacagagtttggctcctttggtcaatagctgggtggtagctggccaaggtgaatctgggctgggtaatttactgatttacaggagtcctgttcgacactagattctcatcttaacagcacagatgcagtgactagttccagattaatacttgcagctaacttggaggtatggctggccgctagtgctagctgtgcccttttgcatggcgccatccaggagaagcccaaagccccagctcagtcccctcctgcttccgtaccctgttgtgccctctttgaagggcctctctgccatgcttcctccaagcctcagcctctctcagcctctaaatctcacctccctgtatacttcctcagagat

SEQ ID NO: 84130 - DNA, 818 bp, Homo sapiens
aaaacatagaggttaggattacattgataaataaggattcttatatttacagttgacccttaacacaaggggtattaaggcaccagctgccagcaccccctcaaaaataaaaaatccacatattactttgaactctccaaaaactttactgatgagctcctgctgagtagaagccttactgataaagttaattaacacagattcagtatattatacattatatactgtattcttacaagaaagtgagctagtgaaaagaaaaagttattaaggagcagaagatatattgactttgttaagtagaagtaaatcatcacaaatgtcttcttcattgtcctcacattgaataggctgaggggaagatgaaggcttggtcttactgtcttgggtggtttagctgagaaatttctgttgcctagtgacatcttgctgatcctgaacacctataggcttaggctaatgtttatgtcttagttttttcaaagtaaaaatgttagtaaactaaataaggttagtatattaaagaaaagaaaaatttgttttacaaacttactgtagccttaagtgtaccatgtttataaagtccacagtagtgtatggtaatgtcttagggcttcaaacccaccactccagccttagtgacagagggagactcctcaaaaaaaactaaaaagtaaaagagattataatggagctgagaaatttctgttgcctagtgacatcttgctgatcctgaacacctataggcttaggctaatgtttatgtcttagttttttcaaagtaaaaatgttagtaaactaaataaggttagtatatt

SEQ ID NO: 84131 - DNA, 448 bp, Homo sapiens
aaaacatagaggttaggattacattgataaataaggattcttatatttacagttgacccttaacacaaggggtattaaggcaccagctgccagcaccccctcaaaaataaaaaatccacatattactttgaactctccaaaaactttactgatgagctcctgctgagtagaagccttactgataaagttaattaacacagattcagtatattatacattatatactgtattcttacaagaaagtgagctagtgaaaagaaaaagttattaaggagcagaagatatattgactttgttaagtagaagtaaatcatcacaaatgtcttcttcattgtcctcacattgaataggctgaggggaagatgaaggcttggtcttactgtcttgggtggtttaggctgaagaaaatccatgtataaacccatattgttcaaggtcagttgtaatt

SEQ ID NO: 84132 - DNA, 1094 bp, Homo sapiens
agctctgcctcccgggttcacgccattttcctgcctcagcctcccaagtagctgggactacaggtacccgccaacacgcccggctaatttttttgtttttgtatttttagtagagacggagtttcaccatgttagccagcatggtcttgatctcttaacctcgtgatccaccagcctcggccttccaaagtgctgggattataggcatgagccaccgcgcccagcctttgaggcatcatttattttcatagatggctaggatggggaagagtttgaatgaaatgttttgtcaaagaaaaatatagagccgtgtgctgcatagatgttttggtgaatgacagaccacatatattatggccccttaagattataatggagcaggccaggtgtggtggttcacgcctgtaatcccagcaatttgggaggccgaggcaagcagatcccctcaggtcaggaatttgagagcagcctggccaacatggtcaaaccccgtagtcaggcgtggtggtgcacatctgtgttcccagctactcaggaggctgaggtggcaaaatcgcttgaacctgggaggtggaggttgtagtgaactgagactgcgccactgcactccagccttagtgacagagggagactcctcaaaaaaaactaaaaagtaaaagagattataatggagctgagaaatttctgttgcctagtgacatcttgctgatcctgaacacctataggcttaggctaatgtttatgtcttagttttttcaaagtaaaaatgttagtaaactaaataaggttagtatattaaagaaaagaaaaatttgttttacaaacttactgtagccttaagtgtaccatgtttataaagtccacagtagtgtatggtaatgtcttagggcttcaaacccaccactccagccttagtgacagagggagactcctcaaaaaaaactaaaaagtaaaagagattataatggagctgagaaatttctgttgcctagtgacatcttgctgatcctgaacacctataggcttaggctaatgtttatgtcttagttttttcaaagtaaaaatgttagtaaactaaataaggttagtatatt

SEQ ID NO: 84133 - DNA, 1136 bp, Homo sapiens
cgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacggtattctgtgtggctgtgcataacccagaagaggagagaactgctgtgcgtctgaagtgatggcggagggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtacctttaatcatgattctggaattactcaacctca

SEQ ID NO: 84134 - DNA, 1507 bp, Homo sapiens
cgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacggtattctgtgtggctgtgcataacccagaagaggagagaactgctgtgcgtctgaagtgatggcggagatggagttttgcccttgttgcccaggctggagtgcaatggcgcgatctcagctcaccgcaacctctgcctcccgagttgaagtgattctcctgcctcagcctcccgagtagctgggattacaggcatgtgtcaccacacccagactaatttagtgttttatagagacggggtttctccatgttggtcaggctgtgtctcaaactcccgacctcaggtgatccgcctgccttggcctcccaaagtgctgggattacaggtgtgaaccaccgcacctggcctttaactgtctttttaaaactgctttttattaaatattgaatagtagaacatgtgtaatatattaagggggactgaacacccatgttaagaggtagaatgctaatgttagaaatcccatgtgtgctttgatcttcccaatctaaatccccttctttagctgtcagaggtatctgttattccgaatcttgtgtttggcatttccttgtttttctttacagtcttaaccatatgtgtttattttcctgttctaatttgatgtcaagaaatcatactgtttggatttttctgcaactctattacttgtcctccaacgagtgttcaagagatccattcacattgcaaacttatcctactgtatagccatccattgtaagaatacattttttcatttatattgtgtacattactccagtgaacattcttgaactcctctttttgtatcctgtgcaagaatttctgtatgtaactaaaaaaggaattgctagctcataggttatatgcattttcagccttactcaacattgcccagttgttttctaaagtgtttattatactcatttactattccttttacttcgtatcctcaccaacacttggtattattaaattttaaatttttacgcacttgggtatga

SEQ ID NO: 84135 - DNA, 802 bp, Homo sapiens
tcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaataggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgata

SEQ ID NO: 84136 - DNA, 1260 bp, Homo sapiens
cgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacggtattctgtgtggctgtgcataacccagaagaggagagaactgctgtgcgtctgaagtgatggcggagggcttgaagttcaaagatgtggtcatttacttctctcaaaaggagtgggaatgcttgcactctgctcagaaggatttgtaccgagatgtaatgttggaaaattacggcaacctggtcttactggggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtacctttaatcatgattctggaattactcaacctca

SEQ ID NO: 84137 - DNA, 1049 bp, Homo sapiens
tcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaatagcttggtgttctcaagagtctgccctttccgaggaagaagaggatacaaccaggcctcttaacccagaagaggagagaactgctgtgcgtctgaagtgatggcggagggcttgaagttcaaagatgtggtcatttacttctctcaaaaggagtgggaatgcttgcactctgctcagaaggggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtacctttaatcatgattctggaattactcaacctca

SEQ ID NO: 84138 - DNA, 629 bp, Homo sapiens
gcgcgccggcggcggatccgcagttaaaatggtccgagcgggacccggcctttccccggccgctccgctgactgactgagccggctggccgggcccggactggtcgcctagccggcaggctcgctcgctccctccctcgcgtccccaaagctcgcgcccatcgttctcccggcttccctgggcaaagcatgtagcccccgtcgggcactccggcggcccgcagctgacgcccaccccccaccgtcgcgtgtgtgcccgtgtgtgcgtgtgtgtgcgcaggaagggcgacccctccgggggccgagccagcgagcggcctgccccgctgccgggagcccgcctctctgggtctccctccctcccgtcccggtccccctcctcggggccttctatatgggccaccttctctcgaaggagccgcgtaaccgcccgagccagaagaggcctcgctgttgcagttggtgccgccgccggcgccctctcctcaggctgccccgccggaccccagccaaggtgccccctcagccggcggcgccccggagccgggactgcttcttccgcgggccctgcatgctctgcttcatcgtgcacagtcccggcgcgcccgcccccgccggcccagaggagga

SEQ ID NO: 84139 - DNA, 685 bp, Homo sapiens
tatatcatactcttgttttctcttctcccaatattttatatagaatgtttagggatacattttaacattttcagtttatgtattagaaaacttagagataagactgcagacattctgcacttggagttgaatgcaactattcataaaactttaggttgcctttctttggggtggccataaagcagtacacttgtagatgtatgcaaaacagttcaagtgtgttagagatatttttggaaaaacaactatgaaaagtgaagcatattcatttaacacatacttgttgaacttcaggctttggggagactcacccgcacaccgtccgcgcacgcctgaggctgggatcccgcgcttgctcgccggcgatctgtctgaggtttcttcctcctggggtttcttcctgctgctggaccctccgcgaatcccggcctccggagaccgtcctggtaaggtgccctggccaggacttggtctcagcccagactcagacgcacgatcacacagggctcctacttccccaagtgtcagggacccatccccgggcaacggtggctttcactgtgacccaagcggcggctcgggcctcgcgcatgcgcgctggcggggccgactcccccgttccacccccttttactccgcagagtcaggctgcggaccctttaaaaaaggggcggccgttgggtac

SEQ ID NO: 84140 - DNA, 744 bp, Homo sapiens
aacaaggaattctctctctagcaaaactcttctttaaaaatgaaggcaagtgatatgggaaaccacagcaaattttgatcagaagagtaatatcaactaactccacttggaccgcatggaaacgaggaaggagaatactacagcaacctggaagccagtgaaaaatgatggcaacactatctaagatggtaaaaaattgacgaagaaaagctcatttcgaactgttgaggagagaaatgtatttgcagagagagcatgaaaaatcatgaaccactccatgggttttgccttgtgcaagtggaagcaagggaagaagataaagagatgtttttatggggcttctctacttaacacaatcctgagatttaacacaggatggaaaagaaggcattataaaatttcagtaaggactgtgacctctagagagcagaggctgtatctttttcatttgcatattctgagcatctattacaatgcttcatacatatatagtgtctcactacatattaatatttattgttcaataaatgaatccatgaactcattttatgtgaaactatggaaagtaggacaatctctcctacaagaaatattgatgggatcttgccatgttgttcaggctggccttgaattactggactcgagtgatcctccaacctcggcctcctgagtacatattccctggtctatagatgaagaaatgaaggttcaagaatactggacatctggactaattaaatgaca

SEQ ID NO: 84141 - DNA, 736 bp, Homo sapiens
agaagaggccagggaggatctgagatggccttcttcaacttgtatctattgggatatcaaaattcctttcagaacaagaaaaggaacacaactgaagaaacaaaccagaaggaaccagagcctactaggcttccccccattatctcaaaagatgggaattattccgtgcaccagaatagccacacaagataccacgaagctgtccggaaggtgttgttgaagacgtttcccaatcaggtcttcagaatccccttgactgatgctcagaacttcagcttctggtggtcccatgatccaggagtgcgtccagaggaaaccatgccatggatccggagcccacgccattgtctcataaaaagcgcgatgaccaggtttatggatcactctattctcaatgacaggaccttcagtctgtattaagaagatatggctgcagaaagacaagatgaattgtggcaagagtgcagagggggaaagaaggaggtttcccagttccgatggctgactaatgggaggaggagatggagaaagcacagtaaacagactggactaaaaaacaaaaaaaacaccaacaaaaagaaaaaaggaaaaagaaaacaggggaacgaccgaataacacaaagaaagagagcgacaagagaagggacagtcaaaaaagaggaaaagacaagaaagaaagacgaagcaaagcagaaaaaagacacagaaacaaaaaacacaaccgagaacacagcca

SEQ ID NO: 84142 - DNA, 653 bp, Homo sapiens
tttctaatgcttctaaacacttgtcattctgctgtctgaaatgctcttcctgattctactgtaacctacctccttcttttcctccaagacttagctcaaacatgacttccactattagaccatttgaagttctgcaaatatgccaatcccaggaaaggaatgtctacccagataagggcctttttcacttggactaaccctaagtatgtgtccaatatcctgattccagaagttggcctcttaaaatccaggagtcagggagaagcaagagagtggtaagggaggtcttgtgatcactgtgttctctctccctcccctctgtcacagccatggtgattggattcctgaggtcctgaaaattggatgtgagtggctaggagagatccctgctatgcatctggttagcatggagaccagggaatcagagaatcaaatagtcatttgccaagtactcagaacgagtctactctaatttcagaccagaaggaaccagagcctactaggcttccccccattatctcaaaagatgggaattattccgtgcaccagaatagccacacaagataccacgaagctgtccggaaggtgttgttgaagacgtgtaagtaccttggggtgggcatcatgctaggagaaaaaaagatatgtctgag

SEQ ID NO: 84143 - DNA, 1111 bp, Homo sapiens
tttctaatgcttctaaacacttgtcattctgctgtctgaaatgctcttcctgattctactgtaacctacctccttcttttcctccaagacttagctcaaacatgacttccactattagaccatttgaagttctgcaaatatgccaatcccaggaaaggaatgtctacccagataagggcctttttcacttggactaaccctaagtatgtgtccaatatcctgattccagaagttggcctcttaaaatccaggagtcagggagaagcaagagagtggtaagggaggtcttgtgatcactgtgttctctctccctcccctctgtcacagccatggtgattggattcctgaggtcctgaaaattggatgtgagtggctaggagagatccctgctatgcatctggttagcatggagaccagggaatcagagaatcaaatagtcatttgccaagtactcagaacgagtctactctaatttcagaccagaaggaaccagagcctactaggcttccccccattatctcaaaagatgggaattattccgtgcaccagaatagccacacaagataccacgaagctgtccggaaggtgttgttgaagacgtttcccaatcaggtcttcagaatccccttgactgatgctcagaacttcagcttctggtggtcccatgatccaggagtgcgtccagaggaaaccatgccatggatccggagcccacgccattgtctcataaaaagcgcgatgaccaggtttatggatcactctattctcaatgacaggaccttcagtctgtattaagaagatatggctgcagaaagacaagatgaattgtggcaagagtgcagagggggaaagaaggaggtttcccagttccgatggctgactaatgggaggaggagatggagaaagcacagtaaacagactggactaaaaaacaaaaaaaacaccaacaaaaagaaaaaaggaaaaagaaaacaggggaacgaccgaataacacaaagaaagagagcgacaagagaagggacagtcaaaaaagaggaaaagacaagaaagaaagacgaagcaaagcagaaaaaagacacagaaacaaaaaacacaaccgagaacacagcca

SEQ ID NO: 84144 - DNA, 1435 bp, Homo sapiens
catggtggaaaacagtttcctcagataatcatcatatcagaggtcatcatgtatccttagatatcagcattgccaagaccagggatatagttattagtaatttacaggaaaggctcaaggtttcatttacatgggaaatgagaactagacagtgtggtgactgtttttgttgttaaccttacctcagtgttttatctcgggtggtccccaagaccaccttcaggatcagtgattcactggagggactcacagaactcagaaaagctgttaagttatggttatggtatattatagcaaaagaatatatattaaaatcagcagctgaaaaaaggcacatagggcaaagtctgggggacaccaggcacaagcttccagttgtccttcacctgtgaagtcatgtagacagaccataattctctcagcagacagaccataattctctcagcaacaatgtgtgacaacattcttggagaattgctaaccagggaagctccaccaagccttggtgtccagattttttcttgagggttggtcacgtaggcatagcatgactgatagcccatgtggctgaccttcagttttcagcccctccaaagatggagctgatactacatggcctaaggacttcaccattaatcacattgttagcttagactacctggtatggcctaaggcccccaagtaaattaaaacattcatatcaggcaggatagtccaaggacttagaggttatcttgaatctggacacaggacaaacatttctttggaatgtgaaaagtttacacaatcaagacttgctatgttgatcctttactgcggtattgttttttgttttctgacccaaaagtgatgtgcattgcttacctatcatggcctctggttaaggtgtcagtcttgcctccaaatttcctcctaaagcatggaattggccataaatttgcttagtgattttctgatttagtatcattagtttgatgactagttttattatgtgagtgtgataaaaggttacgcttagtatacaaagaccttcttataagtctagttaataaaactagggccatgtgttactacaacataggagttaactttgtctggaggctttttcaagcccaagaggttgtcatttctttatgtgtaagatactgcccacatactatactgaagtcaggaaccaagaaccggtcaatttacctcagccaagttgcttggactgctttgcttaataatgggtttgccatatctactttaatgagatgtgtggcatggtgatggttacaaaagtgatttgttaattattgcctggtaggaaggagaacatgttttttttgaacctatgcaaatagccacatgtctgtgaaaagtaaagggatacttttgtgtaatatttaaccatgtataccattgtttgtgtactttttaattgtgtcatttt

SEQ ID NO: 84145 - DNA, 410 bp, Homo sapiens
ggaaatgcctccccgaagagggcgcatttgcaattaaagccaagtgacaagaaaaaactgccatgcacagatctggggtctagagggtggggcaggagggacaacaagagcaaaggcactggggacggaagggcttcatgggcagtgggagccccacgggagccccctaggtctggcttgcaagctctctggccctctgctggacaccccagagcaagccagcccctgcctgggactccctgaacacactgcccccagagaaccacaggcagagggactggctcacctgagttccacaggaaagacagactgtcctgagaacagacactcgctcattttcatcactgttcctcaaacaagtagattttgttttaaagcaaacaaataaacagcgttgtcaagttggtcaa

SEQ ID NO: 84146 - DNA, 245 bp, Homo sapiens
aattaatagcagctactattatgaataacaggattttcctttcactgcatgggcgtatctttgcccatcagggatcttcactgtgttcatcattcttctgtatcagaaggaggaagcccatttcctgtgcctgaatgtcagaactgtaaactccagtctcagggacctacctcctggttaataaggttgaagtcagaacacggtcctgaaagtcagggtcagatttccataccttatttggttgc

SEQ ID NO: 84147 - DNA, 870 bp, Homo sapiens
gggatacttaacctataatatacaaaggattttatatccccttataaatatgacatgttcaactattctgcaagagggactatggaaacccctagaaatgtcacttaaggagaatctgggggcattcgggaataattatttgaaaaattgcaactagagagaaggaggagtaaaatggttgacgagaagctttcactaattatccttcctgctggaacaccaaactgaacaactatccacagggtgaaaacccagggtattatatccttagaatttatttctaccagaaagttgccactttatatattctgccaacaagcttgcttgcaagaggagaagccactattattcccgagtcagtggcatgaacacgtggactgcagagataactgaggtaagaaagctatgaacctggaacaagaatcatggggagaagcaatatgcaattttgtgaattatgaatttaagttcataaagggaactgggattgggaccctgtgggaagccctgaagaagaaagaccaggaaaattggtaagagaatcatttcagtttgaatgaaccaggacaaggcaccagagggctttaaccagccatgctgaccacagaatggtgcttaactcagtgccctcttgaatacagaaggaaaaagggcaggcttaaattaaggctgtgcccaggcatcaatgaggtgacgagaagactaaggcttagaagacttaagtaacttgcaaaggtcatggagtgatcaggtggctatgcatataatcccaagagtagtctgtgtgaaagcttatgtgctctatgctgcttttctacatcagaaaggtggaaattctccctctctgttgtatccctcacagaatgacca

SEQ ID NO: 84148 - DNA, 356 bp, Homo sapiens
aaaagattggtgacgaagaagataattaggcaaaagttccagagaagttgcttcaggctgaggaaacagcttggtatgtgcaagaaactacaagcactttgctgacgctgagtggaaattgcatgcagtgttgacagacaataataattaaagctgacacttggagagcacttactggtgccaggcatggttcaaattgtgctttactaattttatatatcagtcttcatagtaatgccacaagataagtggtattttaccctcattctacaaaggaagcatagaggctaaaggaaggctgactggctttaaatctttgcctttaaccactgtactaaacagcttccaagatgcag

SEQ ID NO: 84149 - DNA, 813 bp, Homo sapiens
ctccaagtagccctggtatcttatgttggagaatggtgttagaaaaacaagatctgggtgctagacatactgattgctgctgaaatataattgcttctaggccctctcagttgacatagcaaaaagatatatgtgtatataatacccatacatatataaagtatttatggaaatataaatatttctgtatataaccatctgtatttatataaggctaaacataaatttatactagtgtctccaactacagtctattactgcatggatcattctagcctccccttgcttatttgtaaccttctactccaactgtgagaaacctgtctcctactatctgccatccattttactaattgtttattaattatataaatatatagtggcttcaaaattgtaaacctgtgcccctgtggaaaacaactttatcaactggagtagagtgctatgtacagttccttttgcctttggtcttacagactccactcatttccaaatttacctatgtcagtaccttattcccccatccctttcagtgagattgtttcatacatttgtgatacattaaaattcttttctcacattctgcatttggggactgctattgtaaatggtacttttacatttcaagttctaattgttcattactagtatataggaaagcaactgacttttgtatattaatcttgtatgctgggactttgcaccaggcatttgtcagttctttggcagccatgtcaactgcagataaagacagtttatttcttcctttcccatctgtatatgttttatttcccttaaaaaaatttattttgt

SEQ ID NO: 84150 - DNA, 587 bp, Homo sapiens
tcttggccaggctggtcttgaactcctgacctcacgatccacctgccccggcctcccaagatagcatattttaggtactgttatacaccttgctttttttcacttaaaagtatgtgtattctagaagataaatagatatgtgataaatatagtaaaatgttaaatatagaacctagcttgtagagactgggagtccactgtaaaattctttcaactttgttgttgttctgaaaattttcataatcaaaattggaaatgaaaatacatagtttagagagatttctagaggaattcatgataactctggttcttttttttacagccatataacaattccatcatataaatgtaccattatttacttatcaatgtcttaatgatagaagttttggtttctagtttttggttgttataaacagtgctacattgtaagtatagtaagaattcacagaagttggattcctaggtcacgacttacccattttgaattttgataaatattgctaaattgctctcaggaaaagttgtactgattttactcctgtcaacaaatgtgtagaataaagtggactcattatgcttattta

SEQ ID NO: 84151 - DNA, 288 bp, Homo sapiens
aattaataaataaactgacaaggaattcaaaaattcgggtgggtttatgtaaaaagtgggatttccaccttctcttaaaaaaaaaaaaattggtgggccgggtgtggtggctcacgcctgtaatctcagcactttgggagtctgctgggggtggctttgactttcaaagtacctctcactagagacacaatcatgggatagaagtttccatagtctaggccaggcgtggtggctcacctggatttcacccgcctctttagtagagacaggtgaaaccccatctttact

SEQ ID NO: 84152 - DNA, 405 bp, Homo sapiens
actttggccttctaaagtgttgggattatgcgtgagcctctgcacccagccaaaattttgaaatttgaggcagtctcatctctctgtttttgcttttgttacctgtgcttttggtgttgtatcttggaaatcactaccaaatccagtgtcatggatttattaataattctgtgagattagttaaaaattagaggattaaaataggaaatacaactcgaagcatcacgttaataatttcaacatgaacaatgaagtagaaatacagtagacataaaaagcataaaccagttgatatttgatgaaataacaaatggaaaatactcactaatatactttttgtagaattattataatgtgctaactttctgaaagctcaggccaggtgtggtggctcacacctgtaat

SEQ ID NO: 84153 - DNA, 327 bp, Homo sapiens
gcatttcagtacgacggaacttatgagtgctgtgaatatgcctggaaatgaacccgccagtgattggaataatggtccggaagcagtggttttcaagctgtactcttttagcagttgaggttgctttttcttcaaatgacatgtgcagaaatgtaatataaataaaatagatcagatccaaatttgaagccagggtgaaagcaggggcctgtaattccccacccctccctttgcctcagagctgacacttccaaagagaatgccctttcgttacaggtttgactgaaagtaggctaacgcttggttggatgaagatcattgtttttc

SEQ ID NO: 84154 - DNA, 322 bp, Homo sapiens
gtgaagaattgtgatccaggatcttattggcagcctgttcgcaacaacagcacctagaacagtgcctggcagttagaaggcacttaatattttttttgattgaatgaaattgtctgttgacaatggagtaaaaaaaatgtagtatttccatactatgggatccatacactcattttaaagtaatacgagtttctatgctataacagcacaaattaaaataatagtggtttagataaagaagtatagtttgagtaaaccctccagagctggtgtggaggctccaccctcctcaggaacccagggtgcctactgttgtgtggtt

SEQ ID NO: 84155 - DNA, 370 bp, Homo sapiens
ggcaaggcacagtcgcatatgcctgtaattccagctagtccagagacggacatgggaggattgcttgaatctaggagtttaggaccagcctgagcaacaaagcaagaccctgtctctacaaaaaggaggtttccagataaaagtagactcaatagatatgttaagcatttggaagaaaaatctgttgatgagtataaatagcatctaatgtaaaaaacgaaggatagggacacaacaggaaaagcgaaactttttataaaaaaggagacattatcacagtaaatttcttggctttacagtaagcagtatttccctaatcataatgcagaactacagccagtttaaccaaaaattgggatgaaatatagtg

SEQ ID NO: 84156 - DNA, 684 bp, Homo sapiens
ctgggcagaagccagccacggacagtgaattatctggaaatgcgtctccctgaggcgcgtttacaatacaaaactttattgttgttttatcatccaaatgtgtatatatttatgttgttttgtgcaactgtatactgccaataatcactttaaaatgtttaatacttagagcgctggatcaaggcaaattcctaacaacttgactcggaactcacacacggcacccatcccgtgacagagcaccaccggggtggctgacaagacttctgaccccaaaacgcggttctgcggagagagtggggcaggaccggggagcaaggcgccgctccccaccgcccgagcgctcgctactccagggccgcagcgctcggtcccgccggggttcgcagcccggcagccctccaggcctctcagctcctaggccggggcctctcccgctcccagcgccccggtaccccgcggcccaagccgaggcccctccttgcgcccgggccgcgaccaccccccaggcccacgctccccgctccccgctcccgcactcaccggctcgggaaagcacgtcacttccggagcgtcgcaagcggccgaccacttccggggccttttggctccggaagcccaaggcttgcccagtgcgcaggtgcagaaaacacgccgacggaccgagaggcgaccttgtccctg

SEQ ID NO: 84157 - DNA, 801 bp, Homo sapiens
gggaaattgtgaagactaaaaaaaaagtgtttcattttatggaaaaggaaagttagacatttgttaaatattaatgacattgaatgtgcttaatggttttgtggtgatgtagaaaagggtttctcaatcttggcattattggcaaactggaccggtgcatgctttgctgcggagagtgtcctgtgcattgtgggtgctgagcagcagttctggcctccaaccgccagatgtcgagagagcttttccttctcccattgagacaaccaaaaatgactctagatgccgccatgtgtcccccggcgcgcaaaattgccccctgtttgacgatcatggtgtgagacgatgttatcattaccagtagattcatactaaaatatttcagggtgaaattttcacagtttattttcagatagcttaatcagaattgaaaacaggataaaggcaaaaagagaacatttttgaaaaaagaaaagaattaaaaaaaaaaaaaaaaggaaatggaaggataagaaaaaaaactatgagagccaaaattcacaggccaggcaagtcacatcaggcctcataggggttgacaagctgcagtgttgagtgctttacacagctgggcaaggagtgaggacagcttctccatccatatgaccctgcttttaggagaggaatgcgtgtgatacaacatgtagaatactggagactcgagtttaaccacagggttatttatttaatgatgaaagagctaactagcagatgcgtattttccttgggcattacacagaggacttacattaaattgtcacataa

SEQ ID NO: 84158 - DNA, 715 bp, Homo sapiens
ttctctttactgtgctctacagaacatttctatgatatgtgtggagctaatgagattacagttataatttttgggggggataattaggaaggtattgataatgatatataaaggactagaattttgtgggataaaggttgctgtttgtagaaaaatcctcccacacatgagggaaaaaaatccaacaaaccaaaaacaggaataatataatgtgtttagcttttaaatgttctaaacaactataaagtacagtagagtgtgtagtaagcaaaaccatggtcagttagggtgttaaacttttgaatcaagagacctggaatctcttcccattaattaacaattaactttggggaagttacttaaattttctttttctttctttccccatttattgagaatgataccaaaaactcacaaattctgaggattcagtatgttgcttaagaaagagtttatcttgggattggtttagtgagtataagaggaaagttagttagcaagaacgctcaggctttgaccattatttccttcatttaaagcatagttcaattgagtataagttttactaattctgggaagtgtgaattgtatgtaagattggaagacaggaccaccttttatcttatcaagtactaaaataaattactcaccatacttttctgttaaccattatgaattgttatgtattctgggttatatttattagtattttaat

SEQ ID NO: 84159 - DNA, 1208 bp, Homo sapiens
cagtcttttcgcgacgagtgccctccgccaccctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgcctatgagcagccacattgccttactgaaatccagagcctaaccttcaatcccaccgccggctgcgcgtcgctcgccaaagaaatgttcgccatgaaaactaaggctgccttagctatctggtgcccaggctattcggaaactcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagttttatggtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaaagacagacattccttctacatgtaatgacacttcttgtgttaaactaaaaatttacaagagaagaaagtgaaagcaaatggggtttcacaaatagttgtaaatatagtgaagcaatttgaaataattttcaagcaaagtattgtgaaagtattctaagccaagttttaaatattatctaacagacaagagtggtatatacaagtagatcctgagaagtacctttgttacagctactataaatatacatataaattatagaatctactttaatttattttgtgaacacttttgaaaatgtacatgttcctttgtaattgacactatatatttcttaataaaataattctcaaatttg

SEQ ID NO: 84160 - DNA, 1397 bp, Homo sapiens
gcagccagaaagctctggagcatcagggagactccaacttaaggcaacagcatgggtgaataagggcttcctgtggactggcaatgagaggcaaaacctggtgcttgagcactggcccctaaggcaggccttacagatctcttacactcgtggtgggaagagtttagtgtgaaactggggtggaattgggtgtccacgtatgttcccttttgccttactatatgttctgtcagtttctttcaggaaaatcttcatcttacaacttgtagggctggtgttaacttacgacttcactaactgtgactttgagaagattaaagcagcctatctcagtactatttctaaagacctgattacatatatgagtgggaccaaaagtaccgagttcaacaacaccgtctcttgtagcaatcggccacattgccttactgaaatccagagcctaaccttcaatcccaccgccggctgcgcgtcgctcgccaaagaaatgttcgccatgaaaactaaggctgccttagctatctggtgcccaggctattcggaaactcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagttttatggtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaaagacagacattccttctacatgtaatgacacttcttgtgttaaactaaaaatttacaagagaagaaagtgaaagcaaatggggtttcacaaatagttgtaaatatagtgaagcaatttgaaataattttcaagcaaagtattgtgaaagtattctaagccaagttttaaatattatctaacagacaagagtggtatatacaagtagatcctgagaagtacctttgttacagctactataaatatacatataaattatagaatctactttaatttattttgtgaacacttttgaaaatgtacatgttcctttgtaattgacactatatatttcttaataaaataattctcaaatttg

SEQ ID NO: 84161 - DNA, 5489 bp, Homo sapiens
attttctctttctggctgcgcgggatggaggggaccagtcgcgctgggggtgggcgcgcgctgaggcgggggtcccgccgcgcggggcggaggcgcgggcgggcgcaggcggccccacgggacgcggctgcgctcggcggaagacgcggcagccctgcgagagtcagcagcggagacgcggtgctcctcgggcgccaagcggaaaatttcaaaaatgtttcaaattcctgtggaaaatcttgacaacatcagaaaggtgcgaaaaaaggtgaaaggtattcttgtggatattgggcttgacagctgcaaggagttactgaaggaccttaaaggctttgatccaggagagaaatactttcataacacatcatggggagatgtttctctctgggaaccttctggaaagaaagtgagatatcgaacaaagccatactgttgtggcctctgtaaatactctacaaaggtgcttacttcattcaagaatcatttacatcgttaccatgaagatgaaattgaccaagagctggtgatcccttgcccaaactgtgtatttgcatctcagcccaaagttgtgggaaggcacttcagaatgttccatgcacctgtccggaaagtccagaactacacagtgaatattttaggtgaaactaaatcatctaggagcgatgtgataagtttcacatgtctaaaatgtaacttttcaaacactttgtactacagcatgaagaagcatgtgctggtagcccattttcactacttaattaactcctactttggcctaagaactgaggaaatgggtgagcaaccgaaaactaacgatactgtttctatagagaagatcccaccacctgacaaatattactgtaaaaagtgcaacgccaatgccagcagccaggatgcgttaatgtatcacattttgacatcagacatacacagagatttggagaataagcttagatctgtgatttcagaacatattaagaggactggactcttgaagcaaacgcacattgctccaaaaccagcagcacatttggctgcaccagcaaatggcagtgctccaagcgctccagcgcagcctccttgcttccatcttgctttgccacagaacagtccaagcccagccgcaggacagccagtgactgtggcccagggtgcccctggaagcctcactcattccccccctgctgctggccaatcccacatgactctggtctccagccctctgcctgtgggccagaacagcctcaccctgcagcccccagcacctcagcccgtctttctttctcacggggttccacttcatcagtctgtgaatcctcctgtgttgcccttgagtcagccagtcggacctgtcaataagtctgttggaactagtgtcctccccataaatcagactgttcgccctggggttttacccctcacccagcctgtgggacccataaacagacctgttgggcctggtgttcttcctgtgagcccctctgtcacccctggggtcctgcaggctgtctcgccaggggtgctttctgtgagtcgggcggtcccgtctggagtccttcctgcaggccagatgactcctgcaggccagatgactcctgcaggggttatccctgggcaaacagcaacttctggggttcttcctactggccagatggtccagtcaggagttctccctgtgggccagacagctccgtcacgggttcttcccccaggccagacagccccattgagggttatctctgcaggccaggtggtcccatctgggcttctttctcccaaccagacagtctcctcctcagctgttgtgcctgtaaaccagggtgtgaattctggtgttctgcagcttagtcagcctgttgtgtcgggagttcttcctgtgggccagccagtgaggcctggggtcttgcaactcaaccagactgtgggcaccaacattctgcctgtgaatcagccagtgagacctggtgcttcgcagaacaccaccttcctgacatcaggctctattctcagacagctcatccctacagggaaacaagtgaatgggattccaacctacacgctggcccccgtgtctgtcactctgccggttccccctggaggccttgcgactgtcgctccgccccagatgcccatccagctcctgccgtcaggtgcagctgcaccaatggccggttccatgcccggcatgccctctcctccagtgctggtgaatgctgctcagagcgtgtttgttcaggcctcctcctctgcagcagacacaaaccaggtgctcaaacaggccaagcagtggaagacctgccctgtctgcaacgagctctttccgtccaacgtctaccaggtccacatggaggtagcgcataagcacagcgagtccaagtctggtgagaaacttgagcctgaaaaactggcagcgtgtgcaccatttctaaagtggatgagagagaaaacggtgcgatgtctgtcttgtaagtgcttggtctctgaggaagagcttatacaccacttgctgatgcatggcttggggtgcttgttctgtccatgcaccttccatgatatcaaaggtctttcagagcacagcaggaataggcacctggggaagaagaagttgcctatggattatagcaacagaggttttcaattagatgtcgatgccaatggcaacctgctctttccccaccttgatttcatcaccatattgccaaaggagaagcttggggagcgggaagtctacttggcaatcctggctgggatacactccaagtcactggtgcctgtgtatgtgaaggtgaggcctcaggctgagggcacccccgggagcaccggcaagcgagtgtccacctgccccttttgctttggcccctttgtgacaactgaggcctatgagctgcatttgaaggagaggcaccacatcatgcccacagtccacacggtcctgaagtctcccgccttcaagtgcatccactgctgtggggtctacacgggaaatatgaccctggctgccatcgccgtccatttggtgcgctgcagaagtgctcccaaggacagcagctcagacctgcaggcccagccgggttttattcacaacagtgaactgcttttagtcagtggtgaagtgatgcatgattccagtttttctgttaagagaaagctgcctgacggccacttaggggccgaagaccagcggcatggggaggagcagcctcccatcctaaatgccgatgcagccccgggtccagaaaaggtgacgagtgttgtgccttttaaaagacaaaggaatgaaagcagaacagagggacctattgtcaaggacgaggctcttcagattttagcattagatcctaaaaaatatgaaggccgttcttatgaagaaaagaagcaatttcttaaagattatttccataagaaaccatatcctagtaaaaaggaaatagaactgttgtcctcactcttttgggtgtggaaaattgatgtggcttcattttttggaaaaagaaggtatatttgcatgaaagcaataaaaaatcacaagccttctgtacttttaggctttgatatgtctgaacttaaaaatgtgaaacatagattgaactttgaatatgaaccataaaacttgcaaaaaaaaaaaaaaagtaactctaaagtagtaggtagatttttttcagttgaaatttcacagtgttgtcctcactgtgttggtgaatcaacctcagtggtcactgtgctgctctgcagagttacttcaggtgctggagagacccctgttaccaggaagccagtagttatttcacatctattgtttcctgcagtttgatttgtaacagaacagttgttttcaggtttttttctctgtcatgtaaatgaaatcttttgatatttcatgcacgccttgttttcccactagtgtcagtatcgtatgataagaaactgaaatctataaataatttgctttttcattaaggacatttcagcctttttcagaatacttgatttaactgcgagtggaagcatcgatctccttcagctttccctgtagcagcagatggtacagtgagtgttcagagacgtgggtacaaaccctgtgatgtatgtataaggctccctgaggatgcactgcattaacttacgctgacttctttgtaagatctttgcttatagattataatttagatctgtatttttttaggtttatcctaatagctgttttttttttttaaccataactcatagaaaatcaaatgtttttatttgttaaaagtagactgaatttgacatctggtatgctggtatgtagctcatacatcaagagttattttacaaataaatttattctgtagatgcagaaatatttttcagtgtagattttcccttttgatatgctaagtcatttctccgttcagaggtaaaacaataaatttttagtgcctttagaataaacattgaaagaatacaccccaaaactcttctcctaacttaactactcataaactagtgaaagggaaggtctatgatactcaggaataagattattgcccctgagtgtgaaaactaacttaaatttcagcatagggtttcaggggacatggcgaagtttacagactgagatctcagtctccatggttggtacagtaagtctttgaccacattttctgaaggtcatgtttagtggagaaacgggcttttctctagctggtttaggctggaagctgtgtccgggtcgatgggatggcatattgttaaagaatctccattgtcgtcactgtcctgtggatgttaaacctcgtttttttccccacacgatattaaaacttaaagcaccagaaccagtcatggagaccagccagtttagatggtaagtcatatttctggtggtacacagcagaggaaccccttcactctatctttaggtagaaatatttggaggatgtgacagcctctgagaaacataatgttactatgtggattttaaaaaatataatacttgcatgtaattgctataatgttcatatttgaggcagttgtgaaactggtttatgattgttggtgtactctgttgtaaattcaaagagagcttgttgaacattttttttttttacctattgttttcagagtgtctattttgaattaaaatttgttacaccgctaaaaaaaaaaaacaaaaacaacaacaagacaaaaaaaaaaaaaaaaaaagaaaaaacaacaggggggccggccgacccaaaagaatagaaattctacgacgaggggggcacccacgaactatgacgaggagacacacgaatgtgatctcacaaaaacaagggggcccaccaaaaaggggagacgctgctgattactaaccgaaggacgcacaggacgcactgggatacaaacaagaaacggtgcagtgtagtgagaaaacaaacggcaatcggcggaatcatcctagcggagacgggaacacacatacgcgagggggaggagcgaaaaaagcgaagcgaagataa

SEQ ID NO: 84162 - DNA, 5144 bp, Homo sapiens
attttctctttctggctgcgcgggatggaggggaccagtcgcgctgggggtgggcgcgcgctgaggcgggggtcccgccgcgcggggcggaggcgcgggcgggcgcaggcggccccacgggacgcggctgcgctcggcggaagacgcggcagccctgcgagagtcagcagcggagacgcggtgctcctcgggcgccaagcggaaaatttcaaaaatgtttcaaattcctgtggaaaatcttgacaacatcagaaaggtgcgaaaaaaggtgaaaggtattcttgtggatattgggcttgacagctgcaaggagttactgaaggaccttaaaggctttgatccaggagagaaatactttcataacacatcatggggagatgtttctctctgggaaccttctggaaagaaagtgagatatcgaacaaagccatactgttgtggcctctgtaaatactctacaaaggtgcttacttcattcaagaatcatttacatcgttaccatgaagatgaaattgaccaagagctggtgatcccttgcccaaactgtgtatttgcatctcagcccaaagttgtgggaaggcacttcagaatgttccatgcacctgtccggaaagtccagaactacacagtgaatattttaggtgaaactaaatcatctaggagcgatgtgataagtttcacatgtctaaaatgtaacttttcaaacactttgtactacagcatgaagaagcatgtgctggtagcccattttcactacttaattaactcctactttggcctaagaactgaggaaatgggtgagcaaccgaaaactaacgatactgtttctatagagaagatcccaccacctgacaaatattactgtaaaaagtgcaacgccaatgccagcagccaggatgcgttaatgtatcacattttgacatcagacatacacagagatttggagaataagcttagatctgtgatttcagaacatattaagaggactggactcttgaagcaaacgcacattgctccaaaaccagcagcacatttggctgcaccagcaaatggcagtgctccaagcgctccagcgcagcctccttgcttccatcttgctttgccacagaacagtccaagcccagccgcaggacagccagtgactgtggcccagggtgcccctggaagcctcactcattccccccctgctgctggccaatcccacatgactctggtctccagccctctgcctgtgggccagaacagcctcaccctgcagcccccagcacctcagcccgtctttctttctcacggggttccacttcatcagtctgtgaatcctcctgtgttgcccttgagtcagccagtcggacctgtcaataagtctgttggaactagtgtcctccccataaatcagactgttcgccctggggttttacccctcacccagcctgtgggacccataaacagacctgttgggcctggtgttcttcctgtgagcccctctgtcacccctggggtcctgcaggctgtctcgccaggggtgctttctgtgagtcgggcggtcccgtctggagtccttcctgcaggccagatgactcctgcaggccagatgactcctgcaggggttatccctgggcaaacagcaacttctggggttcttcctactggccagatggtccagtcaggagttctccctgtgggccagacagctccgtcacgggttcttcccccaggccagacagccccattgagggttatctctgcaggccaggtggtcccatctgggcttctttctcccaaccagacagtctcctcctcagctgttgtgcctgtaaaccagggtgtgaattctggtgttctgcagcttagtcagcctgttgtgtcgggagttcttcctgtgggccagccagtgaggcctggggtcttgcaactcaaccagactgtgggcaccaacattctgcctgtgaatcagccagtgagacctggtgcttcgcagaacaccaccttcctgacatcaggctctattctcagacagctcatccctacagggaaacaagtgaatgggattccaacctacacgctggcccccgtgtctgtcactctgccggttccccctggaggccttgcgactgtcgctccgccccagatgcccatccagctcctgccgtcaggtgcagctgcaccaatggccggttccatgcccggcatgccctctcctccagtgctggtgaatgctgctcagagcgtgtttgttcaggcctcctcctctgcagcagacacaaaccaggtgctcaaacaggccaagcagtggaagacctgccctgtctgcaacgagctctttccgtccaacgtctaccaggtccacatggaggtagcgcataagcacagcgagtccaagtctggtgagaaacttgagcctgaaaaactggcagcgtgtgcaccatttctaaagtggatgagagagaaaacggtgcgatgtctgtcttgtaagtgcttggtctctgaggaagagcttatacaccacttgctgatgcatggcttggggtgcttgttctgtccatgcaccttccatgatatcaaaggtctttcagagcacagcaggaataggcacctggggaagaagaagttgcctatggattatagcaacagaggttttcaattagatgtcgatgccaatggcaacctgctctttccccaccttgatttcatcaccatattgccaaaggagaagcttggggagcgggaagtctacttggcaatcctggctgggatacactccaagtcactggtgcctgtgtatgtgaaggtgaggcctcaggctgagggcacccccgggagcaccggcaagcgagtgtccacctgccccttttgctttggcccctttgtgacaactgaggcctatgagctgcatttgaaggagaggcaccacatcatgcccacagtccacacggtcctgaagtctcccgccttcaagtgcatccactgctgtggggtctacacgggaaatatgaccctggctgccatcgccgtccatttggtgcgctgcagaagtgctcccaaggacagcagctcagacctgcaggcccagccgggttttattcacaacagtgaactgcttttagtcagtggtgaagtgatgcatgattccagtttttctgttaagagaaagctgcctgacggccacttaggggccgaagaccagcggcatggggaggagcagcctcccatcctaaatgccgatgcagccccgggtccagaaaaggtgacgagtgttgtgccttttaaaagacaaaggaatgaaagcagaacagagggacctattgtcaaggacgaggctcttcagattttagcattagatcctaaaaaatatgaaggccgttcttatgaagaaaagaagcaatttcttaaagattatttccataagaaaccatatcctagtaaaaaggaaatagaactgttgtcctcactcttttgggtgtggaaaattgatgtggcttcattttttggaaaaagaaggtatatttgcatgaaagcaataaaaaatcacaagccttctgtacttttaggctttgatatgtctgaacttaaaaatgtgaaacatagattgaactttgaatatgaaccataaaacttgcaaaaaaaaaaaaaaagtaactctaaagtagtaggtagatttttttcagttgaaatttcacagtgttgtcctcactgtgttggtgaatcaacctcagtggtcactgtgctgctctgcagagttacttcaggtgctggagagacccctgttaccaggaagccagtagttatttcacatctattgtttcctgcagtttgatttgtaacagaacagttgttttcaggtttttttctctgtcatgtaaatgaaatcttttgatatttcatgcacgccttgttttcccactagtgtcagtatcgtatgataagaaactgaaatctataaataatttgctttttcattaaggacatttcagcctttttcagaatacttgatttaactgcgagtggaagcatcgatctccttcagctttccctgtagcagcagatggtacagtgagtgttcagagacgtgggtacaaaccctgtgatgtatgtataaggctccctgaggatgcactgcattaacttacgctgacttctttgtaagatctttgcttatagattataatttagatctgtatttttttaggtttatcctaatagctgttttttttttttaaccataactcatagaaaatcaaatgtttttatttgttaaaagtagactgaatttgacatctggtatgctggtatgtagctcatacatcaagagttattttacaaataaatttattctgtagatgcagaaatatttttcagtgtagattttcccttttgatatgctaagtcatttctccgttcagaggtaaaacaataaatttttagtgcctttagaataaacattgaaagaatacaccccaaaactcttctcctaacttaactactcataaactagtgaaagggaaggtctatgatactcaggaataagattattgcccctgagtgtgaaaactaacttaaatttcagcatagggtttcaggggacatggcgaagtttacagactgagatctcagtctccatggttggtacagtaagtctttgaccacattttctgaaggtcatgtttagtggagaaacgggcttttctctagctggtttaggctggaagctgtgtccgggtcgatgggatggcatattgttaaagaatctccattgtcgtcactgtcctgtggatgttaaacctcgtttttttccccacacgatattaaaacttaaagcaccagaaccagtcatggagaccagccagtttagatggtaagtcatatttctggtggtacacagcagaggaaccccttcactctatctttaggtagaaatatttggaggatgtgacagcctctgagaaacataatgttactatgtggattttaaaaaatataatacttgcatgtaattgctataatgttcatatttgaggcagttgtgaaactggtttatgattgttggtgtactctgttgtaaattcaaagagagcttgttgaacattttttttttttacctattgttttcagagtgtctattttgaattaaaatttgttacaccgct

SEQ ID NO: 84163 - DNA, 758 bp, Homo sapiens
gcggggggatcgcctgagcccaggagtttgagaacaatagatgttctaacaaatatttgttgttgggctttcaggagctaaatgaatgggctaatgacatttgttcaaccttaagataatttttatatgaccctctgtgagaggttctaataattctttttttaacaaacgaataagaatattaacaacaatctaggtaaatatttcgaaagagttcttcctttggaaaaagcaagccgagtgttgatttaaatttctcaatgatcaaagtgttaaagtaatatgttttgaatagagccatctataaaacatacccatataaacaacaaaacttgtaaatgtgtaatgggcaaaagtaataaaactattgaaataatgcattttcctcataccaactctatccattaattttttacagttttctaccatgtaacattacccttcataaaaatgatattttaaaatgagatggggttggtaaaagaaacaaggggtaataatggaaggaggattgcaaagctgtgctctgctggatgagggagaagggaaaatagaattcatttgggctttctgtgagccagaggccatggtctgtagcctttaaagggatgagcaatgctcagagccaagggtttttatatctttattttgattatttgtttcttttctctaaagaaatcaagcacaagctattaaaataatgaaagtcacttcaatataatactttataagcaaatttgtgaatctctcatgtatta

SEQ ID NO: 84164 - DNA, 852 bp, Homo sapiens
agggttcttgccccctaaactgccaagtatcgcaactccaggtgactcttgaaatacttggtttggagtacctagggctacagagagctcaacctgaaaattagctctgagctatatttcaactttcttctaaactcaaattttgaaaaagtcagaaatatgtaaaatctcacattttaaaaatttttcaataagtttaatatatccacaccaaactgcttgtatatctatcatatatactgaatattcatcaacctatttataagtgtccaacaatatgcagtgtttgtatataaatacaaaatcaacttgttactcttaaaagcccactctcagtctattctataaaacaaaaacaaataattttttaaaattgaagtgaagaaaaaagatttccacctttagtaagactttagaaaaaagatggagtttgtcatcttcagaaagagagcaaggggagagagcatcttatcactcatgctctcaccgtctcagccttcagcacctggtgtagcatgggctacccctcacttaatgatgtcacataaagcacacagaggaaccatgacttcctggataccaaggacaagtgatctccaaagaccctttgtgatgtttacaatgtagagatctggctgggcatggtgactcacgcctgtgatcccagcactttgggaggctgaagcaggaggattgcttgagctcaggagtttaacatcagcctgggccacacagtgagacctcgtctttaaaaaaatcagacatcatctttaaaaaaatacaaatttggctgggcacagtggctcatgcctgtaatcccagaaatttgggaggccgaagcgggtggatcac

SEQ ID NO: 84165 - DNA, 294 bp, Homo sapiens
ctgcaaacccttcagcatttagctaaagttatttcacaattcaatgcttgtcttgcactgtcctggtcatttaaaaactggtatctcttcaatagcaaatagtatcataacagaccactaaatttggagggaaagtggtttctattgcagatggatgtaattaaaattggtgtaaatcacagggtacagaattcttatctggtaagaattctgacttttttttaaagaagaaaaaatatatccagatctgtatccacatgctatttaaatgctcaggacaaaaagaagccacta

SEQ ID NO: 84166 - DNA, 388 bp, Homo sapiens
tacaaacaccgcaatctatcaaaaaaaaaaatctttttttttcactttttccattgtttattgagctatatactcaagtcttagtcttgtttaacaaaatacttgtgtttctttgtatatctacagtattttctttggggttgtgctttgaaatgcctggaagaatacagtttatgaattcagtatgttggtgttgctagtaatatagatatttttacaaaacttattttgggaataaactttaatttgactgggaagacatttcatatagattctgtaaaaaaatttagcttgcagctattttataaataaataaagaatgcatttctttcatattaaacttctggtgactgccttttcacaagattgcggtgttcacacggtctta

SEQ ID NO: 84167 - DNA, 327 bp, Homo sapiens
tagcacttaaaaagtttccctttgtcctttagaaagtttctgattgaataacaaaacagatgaggcaatgtaaatcaaaggctatttaagataatgatatccttttcctttagaggaatcatctgaatagtgtgaaggaaaagggactttaaaaaaacattttccccataaagtacattaaaatagacatcagaataaaatatgggcaagctttagaactatacccatccaagcactgggatcctgccaaagatactgcacaaaaaataaaggagatttttaaaattacaacaagtagaaaaaaatactttggacattcttcaaagt

SEQ ID NO: 84168 - DNA, 264 bp, Homo sapiens
aaatactggtaaacttaaattgcagagatgccttttaaaaatgcatagtaaaaatatttcatctttacttttctcttcaaatgattttaagatttttacatttttccagttgatgaataacttaaattatgagatttcatgggcataattattttctatatttattgttactttttaatattcttaatactttgcttagaaggtatttaaaagtgaaatttcaaactttttagtacaaaatttcttgaataaataaagttacaa

SEQ ID NO: 84169 - DNA, 206 bp, Homo sapiens
ctggggtttaaaccctgtgttaagccttaaattctatcctttcatcagataatacaaatgctggggttccacacttccataactttttctgattattttcaatgatcaaagtcaaagagaatcaaatacatggaccattttatcctctaaaatgaaaggacagattttctttctgtagaagaaaaagtccaggcccacgtagctca

SEQ ID NO: 84170 - DNA, 1574 bp, Homo sapiens
ggacgcgtgggtcgacccacgcgtccgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttgaacccgcacg

SEQ ID NO: 84171 - DNA, 1620 bp, Homo sapiens
gcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttgaacccgcacg

SEQ ID NO: 84172 - DNA, 525 bp, Homo sapiens
tcttttactcatgttaaaaatccaggctgtcaatgacattagtataatagcttattgttttatctcataactatacacacaacaatctcagaatagcaatagcgaccctaccactaacaatgtgactactgaagagagtttaagattatttttcatttttaaaacaccttttaaaggcacttggaatagttcttttctgtgtgattatgcctccaacattgtaaacatttagatttgtttcattttactttcgattttaggaattaccttttgaaatgtaattgtgttttataattacgtaaaatatttaaatgcttcaaaacccaagtctaaaatgtaaactgtatttataaaatataatttctattcctgtttttgccaccttagtctctcctgcccctatcagtaatcattaaaaaacgtttttttaatggtttaccccttgccatggtttgggtttttctacaaagcagagtctgagacaatggatgcgtgcgggtaattaatttggggacgtgaccccag

SEQ ID NO: 84173 - DNA, 322 bp, Homo sapiens
caggatcctatccctcagctgacagacaggcacaggctgctgcaactcaaaaacaaacctcccacgaccttgggtccctccctccggcaaacccagccctgcaccccgggacagccctaaatcgactccttttagaaaatacgctgcaaggccaggcgcggtggctcacgcctgtaatcccagcactttgggaggccaaagtgggcagatcacgaggtctggagttcaagaccagcctggccaagatggtgaaacctcgtctctactaaaaatacaaaaattagccgggggtggtggagggtgcctgtaatcccagctactc

SEQ ID NO: 84174 - DNA, 463 bp, Homo sapiens
atgatagggtcacagtttcttagagtcagaagagacttgagaagttatcgacggatgcacccttgtcttccctgcctcagccgggacacatccaatgcccagaagagagcaggctcatgtgtggggccatttctgtgtggattgtttgaaactttttccaaataatgaactgcagcttatttccctgtgtattctctttaatgattccagtcctgtatcctggataaaataataacatctcatttacctcttatttggaacacatgtcataattgtccatttatttgtgtgatttttgtatcattactctgttttcccttttaaacatgtgtacctcgagagtggaattgtgtctgtttttggtcattgttatttctctagtgttatcacagtgctagggaatgaataaatgaatggatgagaatgatttatcttgttccaaaaggttttaaggaagaataca

SEQ ID NO: 84175 - DNA, 416 bp, Homo sapiens
catttgagtctgggagttcaataccatcctgggtaacacagcgagaccctgtctccataaaaaatgaaaaatatacatataattcattgctatcaggaggaaatttattattaatatcaacagcattttgggaagtcttcaaagcaattaacttttaactgaagaaactatttacccaaattatatcatatgagtgggtggtatcaaaatgaattgaaatcttgaagaaactgtctccaacttggaaagagatatagagggagaatcacattaatgtatcaatctaatatatcaacctaaatgtgtcaacctttaacttttaattaattgttcccttctaattgtttttttccttctacttttaagttcaggggtacatgtgcaggatgtgcacgtttgttacataggtaaacatg

SEQ ID NO: 84176 - DNA, 469 bp, Homo sapiens
atataactctctataaccattttgcttctaccatacttactctcacattccttccctagcttgccttgccctccaaaacaaaaaagcttccaccatgaaattactaattgatattctgccttataaactttgccttgaaagattcctttgaaaaattaatttcatttcctcgatctagccaatgataaaataatgatgacagcaaacagaagtagaaacagcataattttttaaaaaaggaaacatcaaattttgtattgaaaatttacatcagcatttcactagtgaacagacatttcctctgagaaagagtgataattaccatttgcacctcatgtaaggattttcctgaggcctaagaaagctataaataatatagtttcttttgaaataaagaaaaaaaatttaattttctttcatcacgctaacaagaagtaaaataggttgcaaataatggtgtagtaaatgg

SEQ ID NO: 84177 - DNA, 418 bp, Homo sapiens
aaaaatattgcatgttatcattcatatatgggagctaaaaaaagaggatctcatgaaaatagagagtaggttgctggttaccagaggtaaggaaggaggggagagaaggtgggggatggaaataaaaaagaatgtatatggccgggcacggtgactcacgcctgtaatcctagcactttgggaggctgaggcgggcagatcacaaggccaggagtttgagaccagcctggccaacgtggcgaaacccggctctactaaaaatacaaaaattagccaggtctggtggcacatacctgtgatcccagctacttaggagactgaggcatgagaattgcttggacccaggagatggaggttgcagtgagtcgagatcgcaccactgtgctccagcctgggtgacagtcactgtgtctccaaa

SEQ ID NO: 84178 - DNA, 450 bp, Homo sapiens
gaaaaatcacacctcttccttatagaaaattccagttaatacatgtagaaagaaggaggcaaatagaaaatcattgttagagcaccatagtaataattactgcgggtaagatctacctgtgaatgctaaaattaaggagtgaaagtttaaccagaaacatgatatttgtatgatttttaaagtatctcctccaaaatatttagtaaagaaaaaggggaaatccttagttgactgtggagaatattgtcagactccacctttgccaagcaatcaagactgatatcacttggcccggtcaacatcgtatatgcccaggcgtgtttcacctctgttcttcccaataaagcataacctcaatctaaacatgcgaaaacatcagacacccaaattgagggactttgttctaaataaccggccagtgttttcaaagctgtccaggttataaaaaaa

SEQ ID NO: 84179 - DNA, 392 bp, Homo sapiens
gagatggagtcttgctctgttgcccaggctggagtgcagtggtgcgatctcggctcactgcaacctccacctcctgggttcaagtgattgttctgtctcaacctcctgagtagctgggattacaggcccccaccaccatgcctggctaatttttgtatttttagtagagacaggttttcaccatattggccaggctggtctcaaattcccgacttcaggtgatccacccacctcggcctcccaaagtgctaggattataggtgtgagccactgtgcccagcctctaaatcacttcttatgcttgtacatacttattcagtagttttcaccaaatatttaaagatgtaaaggaaatagcacacgtaaaataaggacttattttatggagagct

SEQ ID NO: 84180 - DNA, 417 bp, Homo sapiens
cggccgctcgcgatctagaactagtggccattgtaaaaggtgtatagtgatatcttgtttgaatatgctgttttctaatcacatatgatgatatataatggtttggctatgtgactcctctagatctgtagttatggccagggtggtgactcatacctataatcccagcactttgggaggctgaggtgggaggattgcttgaggccaggagtttgagaccagcttggccaacatgagactgcgactctgtctctacaaaaagaaaaaattagccagatggtggtcagcacacctgtggttccagctactcaggagaccgagtggggaggatcacttaagcctgagaggccaaggctgcagtgagctatgattgtgccacggcactcctacctgggcaacagggtgagaccctgtctc

SEQ ID NO: 84181 - DNA, 566 bp, Homo sapiens
taaataacaagaagcctgattgctggatagtatagtaaaagtatgttttggaagaaactgccaaactgtcttccatagtggctgcaccattttgcattcccacctgtagtgagtgagagttcctgttgctctacattcttgtcagcatttgatattgccagatttttggattttggccattgtaaaaggtgtatagtgatatcttgtttgaatatgctgttttctaatcacatatgatgatatataatggtttggctatgtgactcctctagatctgtagttatggccagggtggtgactcatacctataatcccagcactttgggaggctgaggtgggaggattgcttgaggccaggagtttgagaccagcttggccaacatgagactgcgactctgtctctacaaaaagaaaaaattagccagatggtggtcagcacacctgtggttccagctactcaggagaccgagtggggaggatcacttaagcctgagaggccaaggctgcagtgagctatgattgtgccacggcactcctacctgggcaacagggtgagaccctgtctc

SEQ ID NO: 84182 - DNA, 577 bp, Homo sapiens
agaaatcttttccttctattggacaactcttaactggctggaaggggccacagattccttggagaatctaataaagatttagatcttcccaagaacaaaagttttcatcttcccaaggagcttgagaacaaaactgggcaacaagccactctgcctcttctctttttctttccggtgtatctttaaacaagtttcgttcactgtactcctttgagatacaaaccatcaaaatgaatgtaatataggcaggtgctaatctcaagatcacaacttttgctttgacttttccaaatgctgcatttggatgtctgtttagccagtgactacaacttgagtccgtcctctctcaagctgccccatccctgatgtcatttctgcttaatttgctccacaactctgcttccagcttctggtctctcttaaatctacctatactcttgctagcattaattaaatgaatagaattataacacaaacagaagaacacatgtcataagcatatatttcaatgaatgtccacaaagtaaacacactgatgtccagcaggttttcattcccagtgagatcagtactatgg

SEQ ID NO: 84183 - DNA, 390 bp, Homo sapiens
caaacaaccccacaatctcagtagtttaaaacaatggctggtttcttgactgtgctatgggtccacctcagatctatgagggttctgccagacatccagaagtcccctggcttccatgatcactgaggcaggtaaaagggggagtggtaaattagacactggcttttaaaggcttcagctcagaagtggcacatgtccctgccactcatgttttactgcccaatccctacctcattcagagaagagtaaaatcctaccacacacggaagaggagaactggtatattgctgaacaccgatgacgagtccagcaatatttaagatgagttgactttgaaacacaatgaaaccttattcatttaggttactttaatctagattgagagtgaag

SEQ ID NO: 84184 - DNA, 168 bp, Homo sapiens
gggacttaccatcactccagaatccactacggaggttgaactttctccagtcgtccaggagaccccaactcagcctcctaagaaagttgtagcacaacttccagtatatcaagaggtaacagttccaacaccaggtcaggatcaagctcagcatccaatgtcacccag

SEQ ID NO: 84185 - DNA, 491 bp, Homo sapiens
catgagacagaagactgatggatgtagaagtttctaagaggacagttacgctgccatgttttgaagcaggaagacgttaccacttctcaaaggtctttaattgcctgaccactgcttctctttggaaggctgtcagggtgatggaatctcagatcacagcacagataaaatggacaaagaaagaaagatacaagaaggatgtaaaaatgtccataatgaactcatgtatcttgcggaaacctctaatctaatgagaatggattttgttgagaagattgtacaccaacaattaattattcatggcagagacatcattaagatttcattttgtttaaaggcctctaagtgacttaggaaattaggttaagctagagaagaatttcaagaaagagacaagggaaagcttttcgttatattgactttttctaatattttccagatagatattttgacttggtacataaattatactctgactaaaaatctccaat

SEQ ID NO: 84186 - DNA, 2563 bp, Homo sapiens
  misc_feature (852)..(852): n is a, c, g, or t
gtggcagggcgctggcaggtgcaggtctttgtgcattctcagagggctcttggtcgctcagggaggtggagtgtccactgttctgtgtgcctagttttgctctgggcagtgttgctgaaagggccaggttgtggtgggggcggggctgactgctaaggctccaactgcagtgtcgttggtggggcaaggtgggggtgaagtgcactcctgctgcatgagtggcagggcagggtgcacacacacacgtgggtgctggctgggtgaggcaagcaaaacctgcctgcacatggcaaagggatgtgggaagtatccatgggccccaggggaagctgcagtgtggggagggaatgggtggcactgctgcgtgtctgtgggggccaccccactgggggtctccagtggtcaagttccgtctgccagggtagaagctatgatgggggcttctaggacactcgaggctgacctgaaagcaggtactttcacactgggaccctgcaagaggccaacagattaagggatgctcaggtcagactggcctcttcttatgggcaagacctccccgcagagttcagatctgacagttgccctagggttaaagtctcctatgggagcaagttgattctaggtggatggtcatccttggctgtgctccactacagaggcccctgcaccaaaccctgtgggctccagatcagctggcttgctgcccctacaacttctttaagcagctttccctgccaactcaagtgtccctgctggctgaagggtttcctcctgctgagattccagaggcctgtgcccagagcaggttgctctctgccagttcacctaacttgtgccctcagcatattnggggtcaagaacaagtcccagtgtgtggtagccccatgcagcgttcccagattccttctccttaagccaagcttctctctgtcttccctcctctactcttggtgctttccctctgaagatctcttaggagtgcaccagtactctcagtccctccggggcagctcttctacctggctgcgtctagtcagccatcttgccccaacatctacttttataaagtcagtctcttttcacacattgcatcagtttcttcctagataagaaaatgagtgtaaatttggacttgtgggtagtcagaaagattacaagaaaagagcattaattcctatgttgataacatggaaaaccatctcaatgctgaaacttcattgtgggtacagttgtaaagcatgtgaagacaggccaggcgcggcggctcactctgtaattccagcactttgggaggccaaggcgggcagatcacttgaggtcaggagttcaagaccagcctggccaacatggtaaaaccccgtctctactaaaaatacaaaaattagccatgcatggtggtgcatgcctgtaatctcagctactcgggaggctgaggcaggaaaatcacttgaacccgggaggcggaggttgcagtgaggtaagatggcaccactacactccagcccgggcgacagagcaagactctgtgtcaaaaaaaaaaaaaaaaaaaaaaagcatgtgaagacagacattatcatgacttcaaatttgttaaggcctctaaagaaacaaatgaaatagtcgaatatggagaacagtatttagtttactttatcaaggtattggtattaaaatgatactactaggagaattgcaggagttctggggcagttctttaatatctgcaattcaccatgttaactagcatattgtaaataaaaaaaggaagatgctttccaagttaagagctgtaaagtaattcccaagttgttaagagctgtgaagtaattgagactaagaggtttgatgtactaaaaaaagttacttcattactttactgttgcttctatatgatgtaaactttaaaaattaaggctcaaattttagaaatacacagaggacaaacatacactctaaaacatgtttatttcagtctaaacaaatgttttgtttatggatattagtgtttttgagaaatcactcagaaaatgttacttcatggccttgcaatgcttgatgttagtttagcacatacaagtgcacttttatacccattgtttaggaggttttatttttaaaattttcttttggataatctcaaaacaataaaggcatttagtgagtacaaatttggaaatcccattttatttttatatctattttcattgtttatcttattgtttgagacagaaattgttaccatgtgatgatgatttccctgttgttttactgtacaaatatctgcctaattgtaaaattatgaatataaaattttaatattgtataataatctttcttggaggatttttttgttgttgttcacagcagatactgaatgtatttctctgtttggcttctttctttgaatgaatgatctcccagctttaaaaaatattactggggctgggtgcagtggcttatgcttgtaatcccagcactttgggagtatgaggtgggagaatcacttgaggcaagaagttcaagaccagcctggggaacatagtgagagcccatctctgca

SEQ ID NO: 84187 - DNA, 1531 bp, Homo sapiens
acgtcagtctccccagcacagtggatacctgcgctccaggagacagaatcaagttgagactgatataagtaccccggagttaaagcacacagtccaggagttaggaacttagcaccggtcccttaaaaccttccagaacacagtcacttggctgaatccaccttattccacagttaaaccctcaaggtcatcaaatataggatacaagaaaaaaaaattggctgggcacagtggtccatgtctgtaattccagcactttgggaggccaaggcgggcagatcacttgaggtcaggagttcaagaccagcctggccaacatggtaaaaccccgtctctactaaaaatacaaaaattagccatgcatggtggtgcatgcctgtaatctcagctactcgggaggctgaggcaggaaaatcacttgaacccgggaggcggaggttgcagtgaggtaagatggcaccactacactccagcccgggcgacagagcaagactctgtgtcaaaaaaaaaaaaaaaaaaaaaaagcatgtgaagacagacattatcatgacttcaaatttgttaaggcctctaaagaaacaaatgaaatagtcgaatatggagaacagtatttagtttactttatcaaggtattggtattaaaatgatactactaggagaattgcaggagttctggggcagttctttaatatctgcaattcaccatgttaactagcatattgtaaataaaaaaaggaagatgctttccaagttaagagctgtaaagtaattcccaagttgttaagagctgtgaagtaattgagactaagaggtttgatgtactaaaaaaagttacttcattactttactgttgcttctatatgatgtaaactttaaaaattaaggctcaaattttagaaatacacagaggacaaacatacactctaaaacatgtttatttcagtctaaacaaatgttttgtttatggatattagtgtttttgagaaatcactcagaaaatgttacttcatggccttgcaatgcttgatgttagtttagcacatacaagtgcacttttatacccattgtttaggaggttttatttttaaaattttcttttggataatctcaaaacaataaaggcatttagtgagtacaaatttggaaatcccattttatttttatatctattttcattgtttatcttattgtttgagacagaaattgttaccatgtgatgatgatttccctgttgttttactgtacaaatatctgcctaattgtaaaattatgaatataaaattttaatattgtataataatctttcttggaggatttttttgttgttgttcacagcagatactgaatgtatttctctgtttggcttctttctttgaatgaatgatctcccagctttaaaaaatattactggggctgggtgcagtggcttatgcttgtaatcccagcactttgggagtatgaggtgggagaatcacttgaggcaagaagttcaagaccagcctggggaacatagtgagagcccatctctgca

SEQ ID NO: 84188 - DNA, 218 bp, Homo sapiens
agggagagagggaaaaggctcacaaaaatgctaaccttctgaaattcatacctgcaaagggcaggcatttctattttggggggccaccaccagtcagaaaactggctcaatgaacaacgggtccagatctatcaaagcattgcttatattctaatgaattattcattctcattttgtatatgattaaactaaaattagaaaactgatgtgttccaaca

SEQ ID NO: 84189 - DNA, 433 bp, Homo sapiens
ggcctggcttctcaagccctacacaatctgccccaacccgtatcaacacacccagaacaaaaggtgcccacagaggaacccctaaatccctgctcacagtcatctgcacaaccctgtgactagccacacccccaactctgaccatatttgagaatgtctccatctctagacataaatcctagacacaagggtctatatattctcatggttacacacctacggagccagagtccccagcaaggcatgacttgagaaatctagggaaaggacccaggtcccaactaacactcagtagccaactggtccaaaatcctcgactagctattattccttgatttaagcaccagctttcctaggtaatttttttctctctctttttttttttttttttttttttgagacagagtcttgttctgtcatccaggctagagtg

SEQ ID NO: 84190 - DNA, 320 bp, Homo sapiens
tgctttctttagaaatttagggcagtgtgatgcttccagaggtctgtacaaacaccagctttcattgtgcttgggagtttccatgcctcttccttctcttcgcttagtgcacgtttctgctttttatcagtttgactgcctgagactgattccaacaacccaaactgaacgcctcagctcctccttgtcaaaggaggatgacttgtcttaacaactatttaggtgaattatttctacagtttttgaaagcaatggctctaaacaaattccactggggtgacaagtacaatacaaaggcgtagcctcgagggcttggggtt

SEQ ID NO: 84191 - DNA, 794 bp, Homo sapiens
agagaaatcacatatcatcatgattatccattctctttcctgtggttctgtttatagtccctattacttttctggcccacccatcctcctagatcttattgctgacttaggacagaattattttcttttagaccagtgtttctttgttcaagacttaagcctgtatgtgtcttttcttaacgtcccaccttgttttggtctagattttacagtattgcaaatatgccccagttttataatttaattggtgatgaagatttttctccttgcattctttttgttgtctttagtgggtttcacaggaatgagaatacaataaaaagtcttttctccatcattttcaactgaaaagccaaacagctttaagattgaattgacacagtgaaagctctctcctaataattttcattgatatgaagtacagagatatttaagggatagaatcaacagaacttgctgatttgtgggaaataggggccaagggaaggggagcaattaagggcagtcattacattttcttggcttgagatatttggatgatgatggtgccaattatttgatggagaaagtaggaagactgggttgccaagggaggatatattaagggttacattttggatttattaaaattgagaaatatctgaaatattcaactagggatttcatatattctcttggatatgagtctggaattgccatgggaggatatattaagggttacattttggatttattaaaattgagaaatatctgaaatattcaactagggacttcacatatactcttggatatga

SEQ ID NO: 84192 - DNA, 438 bp, Homo sapiens
accaactactgatcaggatatgtgaccaaaataaggaatttctaatattcaaccacataaatatctattaacataataatatttaattacatttcctcaatacagtcagagaactataggactagaggagggaacaagaaataactaaggcaagaccgggcacggtggttctcgcctgtaatcccagcactttgggaggccgaagctggtggatcatgaggtcaggaggtcgaggccagcctggccaacatggtaaaatcccgtctctactaaaaatacaaaaattcaccgggtgcggtggcaggcgcctgtaatcccagctactcgggaggctgaggcaggaatcacttgaacccaggaggcagaggttgcagtgagccgagatcatgccactccactctagcctggtaacacaacaagactcagtctcagagaaaa

SEQ ID NO: 84193 - DNA, 302 bp, Homo sapiens
taagaatcacagttccacagtcttaaatgcctattacattttttgtaataatagttcttgaggaaagtgctgaatcttgtattctgagtgttggggaactgtctctttccttaaccttggcccttgagaaaatatagctaattcacaactagcggtattaaaaaaaatgagttaacaactgctaatttatcctatagcaaagtgctagatcagagctacaacacatttaagtagaaagaaactagaaacatatatttaaccagaattaattttctagtggggctcaggataccaagaagggt

SEQ ID NO: 84194 - DNA, 421 bp, Homo sapiens
gtgagaggatcacttgagcccaagagtcggagaccagcctgggcaacacagggagacgctcactctacaaaaaatttaaaaatcagccaggcacattggcatgtgcttgtagtcccagctgctactagagaggctgaggtgggaggatagtttgggcctggtaggtcaaggctgcagtgagccatgattgtgccactgcacagagaaagatcctgactcaaaaaattaaaaataaaaataagtaaatagaacacacacaaaaaaatttttttttaaagtgtcttttgcaatcaatttttctctgatcagtgctttcaatgtatcttgattctgatacatagtgttttcaatgtcgtttttaagtttctccttttctttaggagttattaggaggttttaaaaattccaggtagatgaacct

SEQ ID NO: 84195 - DNA, 2377 bp, Homo sapiens
  misc_feature (1)..(1): n is a, c, g, or t
  misc_feature (3)..(3): n is a, c, g, or t
ngnctctcagctgcactcctgtacatccacctgtcttcaggagagcactgtttgtgtgtgcccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccggcttctggtggttcatttaatggattcacacagccccaggatacttcattattcacaatgcagacagaccagagtatgatctgcaacttggctgaatctgaacaggctccacccacagagccaaaagcagaggagcctctggctgctgtcacacctgccgttggtctggaccttggaatggacactcgggctgaggagccagtggaggaggcagtgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaaaaaccg

SEQ ID NO: 84196 - DNA, 448 bp, Homo sapiens
taccttgtattttgaaagatatgttttgaaaaatgcattagtttaggtcagcggttcttgactggaagtgatctctaccccctcagaatatctggcaacatccacatacatatttggctgtcacagcagggatgtgggcaggcgttactgttatctagtgtgtagaggtcagggagacggctggacatgctacgatgcacagggcagctccatatgacaaagaatgtcctggccccaaatatcaatagtgccaagactgagaaaccctgattaagctggaggtaacttcttagatcttctagggaaggaaggagagagggaggaaggaaaggaggaaggggggaaggaggaaggaggaaggaggaagggaggagaggaaggagagaaaaaggaagaaccagtaacctatgctaatgcttttcacaaaccagatccttcaaaatacgag

SEQ ID NO: 84197 - DNA, 437 bp, Homo sapiens
tttactattttgagctatattccttctatattttgtttgttgagggtttttatcatgctgaattttaccaactgctttttctatgtctattgagatggtcatatggttttgttcctaattctatttatgggatatatcacatttattgatttgcatatgttgaaccatccttgcatccctggcacataacacatcatagcgtattatctttttgatgtgctgcttgagtcagtttgctagtattttgttgaggatttgtaatctatgttcaatagggatattggtctgtatttttggtgttgtgtccttgtctgatttgggtactggggtgatactggcctcataaaatgagtcaggaagaaatccctcatcctccattttctggaaccgtttcaggagggttggtactagttcttcataggtttggtagaattcgg

SEQ ID NO: 84198 - DNA, 4071 bp, Homo sapiens
taaggaccttcagagcatcccagggttacagcaagagccactgaggtgtggctggcagagcaactgaggagctctgcgagagtgtgccctctgagacagccctgtccgccccgcccaggtgggacctgacatacaggcggctccagccctgggcagcggcttcaagagccagagtgggaagtcaggcctctctgggaaggtcacaaggcctggggttgttcacaccacaggcacaatacagagctgtccactcttgaactggacggtctggggagaattgagaagctgcctctcactgcatggatagtggtggctgctggtttcaagcgtggttttttgctaagagccagaggcaggtcttctggagttctcaggggggccctgtgaccccctctccacaaccatggccagcatcggcttcttgctgcacctgtgcattctccacccctcccccaatggttccagctcctaaaacacctggacattccccatcctgcaccggcactgtgtttgttcagagaaaacgaagggtgtcatttcttcttttccctgtggcatcgtggatcctttacatttagcaacaacagtgtgaggctccacttccgttgaatatgagcggctgtcacacccatgagcaagtttccttgatggaagatgctgtttctccggcagaaccaaccctccaggacgaagtttcagaattggctgatggtcgtgagtgcaggtgtccctgttgtaatttgcagggaaattgactgcaggcgatagtgttgacgtccgacgtctgacaacctcctatgtgcatgtctaaatagtcacaatgaagatgaaaataaggatgatggggacggggtccaggagggccactgggaaggcactatccagaaatagtggacagaggtctggcatgtggaaaccttggatctcggtcacagggaggaaggcagctagaaatgggagggaagcttctgggtaggcaccatagtaggggaatgtctaaagacccactgctctgagatgtggtcagagaggtttctgtggactgcagatgaggcctgagccctgcctatgctcaaagccatcagggttgggggtccgcctcctcactgctcctcaacagctgtaaccctttcctgagggccccgacttttcagaataggagcagagagaagcccagacttccttccctggagtgtagacctgtgtgtgggacctgctccaggctgatccctgtccgcacaggtgggtgatgtccttggctgctgccgtcagaggcagccccctgcacagggaggggctgatcctgcctcagctgtgtggccatgtgggggcagcaggggcctgggccatagctgggggaggccagaccctgagggctttgcagggcggccagtgcagtgatgcctggcgcttccagctgagacaggagtccggacagaggtgggcagggtggatggcttcgggcagggaaggcgggtagaggctgcatgtgggggcccctgtctgcctgtccttagggtgtggattaggctctggcttctgtgatggtgcaagaggcaggatggtctccagacaccttcttgcagagtgattttgaccaatgcctttccagcaccttcccctggttatgacagggagctcccaggccaggccacatgaccccacaggtaggctgaccccatggacccactggagactttgagggcagagctcgggcacctttcatcttccttgggtggtcctcatgtcgctgtccgctcatgttcctggtgttctggcatcaccttgtgccggtgggggctgggctcccgtgaggtcctagggcagaaggaggtgcttgcagggcctctcgctgctactgggacatccacaggacctaatgtttatgtggaatctccaggctgccatcgagggctcctgagctcatcctgaggacccagggtccatctgagctggctgtgggctgagatcctggctggggccctgctgtcaacctctcctccagccctgccttgtccctgctcctgtgctttcctctcttcaggacaaatggtttgtccttatggtcccctttccactaggattttctcatcctcatctgtctatcccagccggatttaaagcagtcacttcagacaggagccacagggagcctgtgagggagtagtgcggtggtggtgagtgtggctgccctggctcccccagctcaccgtggtgctgtccttgacccacgagctgttgagaagggtgcagagcccctggcacagccaaccctgttgcccccagtgccgctgcccagcttcggccatccaggtggtgggtagacagaggagtgaaccccaaaggtgtccatgccccagttctaagccctgtggccaggtgctgtcacacagcaaaggggactttgcaggtggaattagggttagggatctaaggatgggaggggaacttggtttatctgggtgggctcagtgaccccttggaatggctgagggaggcaggagagcctggaaagattcgaagtgtcacagagatggtgccgtcattgctggcttaaagacaaggggccaggagccaacaccagaggccactccacaaccccagcgccagtcagcaaggaagccgggtgtcgctcacacaaccagaaggagctgagtttggcaacaacccaagtgagcctgaagcagattcgccccagagcctccaggcgtgagtggagcccagtccagcgacaccttggtttggcctgtgagactgagaagagagccagccacgccatgctgtgcctggggtccacagagccgggaggtcacacatgtacatcctggaagctgcccaaggtgtggccacttgtagggcagtgagaggaagccgtcgcggggaccatgctgccttctctgggctcacgactgttctggaaaggaccccatggcagacttggcaaggtctccacttcaggggcaaacatctccatcatcagcaactccaaaccccagccacttcctgggagttcaggaactgtgtttagccataatgtcccttggggtttggtgaaaaacaacttcctttttatttgtgggaaaactgtattatattgccttatttatttttaatcatgtacaatattcatgtacaaatgttagagccattcgggtaggattctctctaaattatttattgaagaggctttgtaaatagtgcaccagtgacaggtgctgcctgtttactcgtaccaaaaatgaagacaagccccacacccacctcagcccttgcttggccatgctgtggccctttggaaatgaccctgtgtgctcccctcgcgacccttgcatgcctttcatgcctgatgccgtagagtagaacacagccccggaatgcttccagttgcttgcaagggaccatgccggcccgggtggtccatgcctgcggggtgtctgtatcctgcaggaggacgcccctacagacccagcaacccaagttgccagcccgtgtttctcagactttaaagccaccagggcttctggaacacctgtcatagaagcaataactctaactctatactgtagagatgagtctggtccgaagcagattagtaatttagagataagccatgcatacaagtttgccccattctctggcttggggtggtgggaggcggggagctgccactcccaaagcctccaccccttcctgaagacccagctatgaaaccgcagttcctgtgggttgggctgcccaggctggtcagagctcagcaccccaggtctggtgagcagacagagccggcgttaaaccccgatcaggtcattgtcaccacacccttgcttggatgaggaaggaaggaggcaaaggcacccactccatccaagatccattccaattgatgagcctcagtactggcctcacactgaccaacggtggtatgctgcagtttgttggtttggtgcagagtctaaaggataacatatcaaggcttacctgtgataggccattttaaggaaatggtggcactctgaaggctgtccccattcaccttccacaatgctggtaccatcctggtagaagagccct

SEQ ID NO: 84199 - DNA, 285 bp, Homo sapiens
ctaaaaaacatttggagaaaatcctaaaaacatacctggttttcttactttgcaataaaagattaatagaggggaaaaagaacaaaacaaattatcagccaggtgtggtgggtcatgcctgtaatcccagcacttttggaaagcccagatgggcagatagcttgagcccaggagttggagacccgcctgggcaacatgacaaaatcccatttctacaaaaaaaacaaaagtacaaaaattagctgggcatggtggcatgcgtctgtgacaccagccactccagag

SEQ ID NO: 84200 - DNA, 967 bp, Homo sapiens
cacaggaaaaaaaagctcatttttaaattgtaaaagtggcatctgattcaatcttggcactgtaaataaagaaaatacgtaattaaaaaaaatccttccaattcactgcagtggaaacaaagaaaataacattccatgtagcaaaatatttaaactagcccataatataagctttgtggtattgctaaaactcagcccagtgcctaaatgaaagaatgtcataagatgaaaaaagatcagtaatcttaatcaaggaaataaatatgaatgggcttaatattcttattagaagatagaaactgtcagatttgggtagaatgcaatttgtaagaaacttgcctaaaataatacaatgtggaaaactgataccaaaaggacaggcaaggatatactataagcctctacatatattgtgaaggacttcaagttacctaagagatgagaaaggaagaggctaggcctatgattgtagggtttctggttagtccttccagattcaaatcctccatctcttcaacttggtcattaattttaactgagaattgtatgtcttacatatcttatagatctgtacatttgtttgccatcaccgcactagcagtttattagtgtatttcttttcactttaaaaacgactcaatcaaacaagtctctgttaatttataagccagtaaaaatatattcacgttatcagtatggctatccaggctgaaattcataaatgggaagactttttacttccctctttgggccagtgtctgtgctgaatattacaatgctagaaaggaaatgggtacaaagagaaagactgctaccgtgtgctaaaggcaagaacactgcaattttagttcaaaagatgcttctttccttttgcagtatcattttcgatgagggaaacataaatcctggtatacagaattggctattggctgatctacttaaaattttgtgccaagctgaaagtgct

SEQ ID NO: 84201 - DNA, 585 bp, Homo sapiens
aatggcttattgttctccctgcagattttcaccgctatgcctcctttcactctgggagtcttccagaggtcttgcactcgggagagcatgctcaggtttccccagctctacaaaatcacccagaatgccaaagacttcaacacaagggtaaataaggttgatctcagaattgtcacctcaaaaaggccctgccttccactgttcagttctggtcatctgcctatgagatatctgaagcttgaaagagaacacttgaaaatcactgagaccgtgactcccatcccagcacacacagcaagccaagtaggttacagagatttcttcttgggtgatgagttcacgccacatggggtatgttctccagttccagtgtgttgactccttcctgcttccccccatcagcccctgaggtcaatgtgggcagcagcccccatggtccaagttcaagatccgctgtggaagacttttttaggcaatcacacagccctgcatggagtcctgatgagagcttgcctaattgttgctaggtttgtcattttaaatacagtgtttctttagctagtgagtaaaattggctatatagga

SEQ ID NO: 84202 - DNA, 669 bp, Homo sapiens
atggtgtaaaataagttagaagtgatagaaaccttcaaagatatattcctggatggagagggttagaaacctttcctcttgactggtttttatttagtagtagtatttgaaaatactgatggtcatggtgataacaacaggttggaatctggaggactcttgatgggatagtgtaatattttggctcataaaatatggaattgttgccttgtcttaaatcagttttcagctggaacattttgtgacttctctggcatggtagccaccatctggccaacacagtctcctgagattcttgcagccaaagtgtctcagcattcacttgaagaaattcattttaaaaatgtctccaaatcctcaaggaccatggctagcaaaaatgtggatatgcatctgagaggcataattatcatgcccctctcattcagaaatgttctgcttcaaaggaatggcacagtgtccttcttgattttgtcactttttttttttccagttacttcttttgacattgttgaaggatgagaataagttcaaggcttcctaaggatgaaggaagcaaagggcctgcggcaaaaatataatcatgaacgattagaggagatgctatgtaaaaattggcactaaagctggattttggagcctcattagcattttagttaattgtctaga

SEQ ID NO: 84203 - DNA, 292 bp, Homo sapiens
ctctgctcctccatgggtacctacgcagaccccagagacatcccagggtccctcggacactcgcagcttcagtttcccagcattgattgcactgctctggggaacagtgcccgtccctccccaagggcccgagggcttctgggaagtgacatcctcttccaggggtggggcctgtggctgaggtctgagccaatcaggataatccctaccccttggctacagtgattggcccaaggatgggcatgtgacctgagcttgttcatcggaataaagatgaatgttttctacaaat

SEQ ID NO: 84204 - DNA, 757 bp, Homo sapiens
aggtcattttgccctggtgggcctgtgcctcaaaaatggggtttcttcccttgtgaggaagacccatgaattagtaacggaattgccaggaatgctaaaaactatctaaatgccatgtattgttttcaagctgttactcctggaaggggctgggttggcattgttttagaggttaggagccaaacatcagctcatctattctccagctgttgtttgtcctccatcttcctgcaatagtcaggcacagggtcttataaaaatgggtttgtgctgctgtatgtttcgcatcaccatcctgtggtcacctgatctcagcgtctaggtcaactttgattcctttcttcttgccctgatggccagtgacatacacagatcccatcgactctaaaaaaaaaaaaaaaaaaaaaaacaaaaaaaacaaaaaaaaaaaaaaaaaaaaaaaaaaagaaaaaaagaagaaaacaaaagacaaaaaaaaaaaaagagggggggggcgccgccaaataatctcagccgaccgagggggcggcgcaccagcaagcacgagcggccaccccgcagcattttgttgtgagaacaagagagagggggcccccactccaagaggaggcggacccccattataaacgacagcaggcgacgagggcgggcgccgatcaaaacaacgacaggggcgacggggagaaaaacagcaggcggaggacggaggacactcttgtggggagaaggaaacaccacaccaagtaggggggggcga

SEQ ID NO: 84205 - DNA, 202 bp, Homo sapiens
ttgtaaatatttgagattggtagatgctgtaggcagaggcagcataaaatgaatgaaaaatctcacatgtctgagaggtcacactgcaagtctaaccctgcctcagttggcagcagggttcatccagaggccattagatttctcgctcctgtgaacacctggaacccagtttcctgccccttcccccacttgatgtgtgtgt

SEQ ID NO: 84206 - DNA, 805 bp, Homo sapiens
tcctggtgctaacacatagactggcacatagcatctacttaagtagtagttgaatgatactgtcgatgttggctagatgcagttgcttttatgaggctaatgtcacaatatatagtttctctgttcacccccttccttagggaaacaatagagaagcctcaagttcctcaggagaaatcagaagcagaaagagaaaaaatgctatcattgtggacacttagaagtgaaatttgaaacaagaaacaacagttttctattgtgtacctacttatattctggacatagcacatcacaatcctacaacaatcctgtgcctgtgaagtcagtatgtggctcccattttacagttgaagaaagaggctaagaaaagtgaaaggctttttaagttcatacaccaagcaagttccacctgactccaaggatcatgcttttcttaatataccacactacctcctttctggatgagaacccaacccaggagtaagggatctagctgtggagctcagcaagcaagatttgtttttattgtctttagcacgaggtaaaattgtcctcagaatttcaatcaagtgttcatcagactaagtgtggctgttaatatttgggtcaggaacaggatttgaataattagtatttctcaattgagagaggaaaacctttgtcaaccaagatgcgttcctaggattcttctagaaaaaggtaaatgggaagcttttcatatctacaattttggtaagcaatattgctaatggctatttttgttctaggcctcgagctccgtttgctagtctagaaattgcatatc

SEQ ID NO: 84207 - DNA, 229 bp, Homo sapiens
atagcctcatgaaaccttttaaaattttattaaggaaatgtaaaataaaataagagtgaaatacaagtatggccatttccttggggagtactggaaggaagacatgagatggatctcatatcctgtttcattaacagtttttcacaccatgcaatttctctctgaacccctttcctgaaacaacagctgtttgctggccataggctggcctagtactggagatgggagt

SEQ ID NO: 84208 - DNA, 983 bp, Homo sapiens
gtgggtatggctgagccgctgcgtgggactgaggggagggggccgggtggacgccgcggaactgcgtcctgaggtgggagaccggaggtgggggaccactgagtctgatgtctggagggtccggttgcgggtcggagggcgtgctggaacagccgccacgcgggagccaggagcctcctgggtgcgtgtgacccacgagccggcaccgtcccgcggccctggggtctgcgaggagccctggcgccgccctccggcttcgcgctttttctagatccctagaaccccagccctccgcctacgctccgcgcccctggcctttttctggcccagggtggggttccgggagtcgtgccgaaggagcccattgccgtccttaaccggttgtaagagcctttcgtgccccggagcctttgaggcttgaatgctgagagtgtgacatggtcctttccctgcagcctggcccatttttttaaatgacatttgaaaaattattgcatcacaccagactcagaaaaggatgtctgggaacttctgaggcttgaaacatgttgaaatacagaattttgttttattcgtaatgggcataggaactaaacattttaagtgcagacatctgatggctataaaaagtttcagtgaaaccgtgctggaaatgtaaacaagaatagacttgttcattccttgattgcgctattaggtctatactaaccatattgtgtcgtcatggcatccgacgattgaaagagacccatgcttaactgcaggacttgttagcacttgaactctccttatttacccagccctttggcgttggggggcattattgccctcggtagctgacaggacgatctttcaggttttccaacaaaatcagccaaacactgcctggcatcggtggacactcttacggatatgcgcgggtcagtgggtgtaaggtgcaattgtggcacagtcggctgagacagtgggacgcatgcacgaca

SEQ ID NO: 84209 - DNA, 116 bp, Homo sapiens
cttcaaacaacctggaaagtatttttgtgaaaattaacatttttgctaactttaggtccaactgaatattttgcctcaaaattagtagagcactcttcagctcagccttgaagtca

SEQ ID NO: 84210 - DNA, 358 bp, Homo sapiens
cccgattgtttgaaacagatgggcagccctggcccttcaaggccagcctttgtggctcagaagagggcagcccagggacctggttggaatttccccatctcccaaccttcacccaccctggcataagatcatcttcatcctctcctgaggcctctgatggttttctctaaggttgagaatccctgctattattttaggaaggaaggacaacccccagaactgcagagtatcttgcttcttgctgactctggtcaagtcagcgttccacccacgaggagccttggagctgtcggacccctggctgagcgtagtgtgggtgtctgggaggtatgtgctgcccactgcagaggctggctcg

SEQ ID NO: 84211 - DNA, 213 bp, Homo sapiens
atcaagtgtaataaagatttttaatgatataccatctgttgttagagcatattatacagacaaatggatgtaagtctggaagttacaagttgaggggcactaaccgcatttatttgagtactatattttgagtagaaagtgtcacatatgaaaatcaccctcctcataagttttcagtctttgttaagtgctactactaatgatgacattgat

SEQ ID NO: 84212 - DNA, 721 bp, Homo sapiens
tggcaacttgttcgggtatccttccccagtgtggaagctttagttcttttgctctttgcaatgaatcttgctgctgctcactctttgggtccacgctgcgtttacactgtgtttatgagctgtaacactcaccacaaaggtctgcagcttcactcctgaagccagcaaagaccacgaacccaccaggaagaaggaacaactccagacacgcagccttaagagctgtaacactcactgccaaggtcttcagcttcactcctgagccagccagaccatgaacccaccagaaggaaaaaactcggaacacatcccaacatcagaaggaacaaactctggacatgccgcctttaagaactgtaacaacgcaagggtccgcggctttattcttgaagtcagtaagaccaagaacccaattccggacacgtttggacccagatggaaaggcagctcaacatctgagaagccagtcttactccctgcaggcaacagctgcttccagaaaacagccctgtaattgtcaccatcaaatccatatattttcaagggaagttggtcccacaccagaagtcatagctgaatcaccagcagtaatgcagggacatactggttgcttcttggcttttccaaccctctgccatgcttgaacatctttgtgaaagtccaggaacaacaaataagcttaaggataaaagccccccagccataccaccacaaccccctg

SEQ ID NO: 84213 - DNA, 309 bp, Homo sapiens
agggttaaaagtgattttgtatgactccttaatcatttagataaatgtatccactgagaaatgttaaataatttggccaaaactagaactagaactagaactagaactggaactggagctgtaactgtaactgtaactagaactagaactaaaactagaactagagcaagaattcaaatctgctgtatttcaggctaaagtgctcttggctacaccagaatcttttctaatttatggtttatcttcaattagcttatcattgaactcacatcccatgatgtaataaaagactccttttagattcctcaa

SEQ ID NO: 84214 - DNA, 200 bp, Homo sapiens
tttagagtgtcaaacatatattttattacattttaaatatttggaagctattttattgaaattagagcatcttaaactcgaatggcttcaaatactagctttctgaggaaaactaacaagttagcattaaaatatttctaagaaagaacaatttctattttcagttggcccaatatcttatcagcaggcagttaaagatc

SEQ ID NO: 84215 - DNA, 411 bp, Homo sapiens
  misc_feature (348)..(348): n is a, c, g, or t
  misc_feature (367)..(367): n is a, c, g, or t
  misc_feature (373)..(373): n is a, c, g, or t
tagtatcatccaacagtcaagaaaggtctggacttcacagcggggctgacgggagtttctgcctactgagtcttgcttgtactcagtggactgtgcagaccattaactacagcaatgattctggcgaggggaggctacgccaccgaggtctgcagagctgtaagttacagagctagggttggccatgctgttgaacagagtgatacatctacacccctcttagtacagttcatggtcaagctcaaatcaaaaccaaagagcaggcgaggcaacatagggaaaccgtctctacgaaaaattagtagagacagggtttcgccatgttgaccgggatggtcttgatctctngactccatgatccatccgnctcggnctcccaaagtgctgggattataggcatgagccactgtg

SEQ ID NO: 84216 - DNA, 1742 bp, Homo sapiens
  misc_feature (116)..(116): n is a, c, g, or t
  misc_feature (191)..(191): n is a, c, g, or t
  misc_feature (222)..(224): n is a, c, g, or t
  misc_feature (1011)..(1011): n is a, c, g, or t
tgagagggagtttcactcttgttgcccaggctggagtacagtggcgcgatctcagctcactcaacctccgcctcccacctgagtagctggattacaggcacctgcaccacacctgnctaatttttgtatttttagtagagatggggtttcgccatattggccaggctggtctcaaactcctgacttcaggngatccatccacctcagcttcccaaagtgctnnnattacaggtgtgagccactgcgcccgcctattcttttgcttttaatttgctgatattaacttgctatgagttatgaatcaaggtaaccaagctgattagaattgaaactaacataaaagttattaggctctgaggtggggaatctctcagggatgaagtaccaggactttgtgactttgtggccctacagtgcatgcgcagtaagagactgatggaggagtttttattatgaagaagtgggagtgccaggcctgccttcacagcaggtcctctccaaatgtgagtgtccttttttctaggaatgatcagacacttacacagctcacagccacattgccttttctctcttgcactatttggattgtagagccccagaacatgcccccagcagaataaccctggtattataacaaagcaaagccactgcataaactagtgggaaccagacatcctcttggagggttccagggtggtgcacacagacaggacctgtggaccagtcctgtgctaatacttggtggttccacggggcccttcttaaatgcaggttgccaggttcctccctgggcttgcctacttcgactcttttaaacagaggcctgagaatctgtattcttaaagcacttgggtgattgtgatgagcagccaggattggaaacctcagaacaagaatatgcttgtatccagtggttgtccctggcctgggtggagccaccaaaatgtctttggatcaggtaccaggagcaggttgaaggtgcttcttctgaagccaaggatgcttgagatngctttctaagacaatactctactctatatcttttcctatccaagttaatgctactgcctgtaacatgaagtgaaaaatcacagttgttaagagcatgtactttggtgcctgggagaactaggtcacaaatcccagtttaacatctgtgtgatcctgggcaagttacttaacttcgctgtgccttagtttctttttttgaaaaaaaaaaaagcatgagcaatgagcagaacacagtgcctggcatttggtaggctcttcaatatcattctaaatagggtgcatttgctggcacagggctctgcagatcctcctaaagaggatcctacgggaggtgagcaggggagatgaccaggcctcaggaaagcgcaagccccctttcccttaatgggtttgtccagttcaggctagatgtgcatcatggcaggaagaaagaaggcactgtcaggctgagaatgatggctcacatctgtaatcctagcattatgggaggctgaggtaggaggattgcttgagcccaggagtttgagaccagcctgggcaacatagtgaaaccctgtctctacaaaaaaaaatacaaaatgttagctgggtttggtggcaagtgcctgtagtcccagcttgggaggttgaggtgggaggattgcttgagcccagaaggtcgaggtcgaggctacattgagctgtaattgtaccactgcactctagcctgagcaaaacagtgagactcaaaa

SEQ ID NO: 84217 - DNA, 332 bp, Homo sapiens
gtggggttcaccgagacatgggcccttaaccaacttgtcagcaaagcatctgtggtattataaggtgtcctcgttgtataaatttcatagatttacaaaagatttgtcacctagattgtcaatcttgagaagactttatttattagaagatatttttaaagtgcttctgttcattaatcatttttttcagactcttttacgtatcttgcttcccttctgcagtcagtccctcaggccctagagaggaggctccctgtgcagtgtctgttgagattggctgattggatttgcattgccaggcccagccaggctttcctctgaggctgacatga

SEQ ID NO: 84218 - DNA, 259 bp, Homo sapiens
tgttcctacaaataatcccactaatcctctctctccccagctgcttccttgcctttcctgcttggctcccctctcataagcctctttctttctaattttttcagaggaacatattttacagtcccgttgcttcacctaccttgcccattgtccttgcctaaaattgtccttgactgaaatagtaagagatagttttcctctgctttttgaaatcttagcatatgttggttggttgagttaactgcttcatatttatttg

SEQ ID NO: 84219 - DNA, 678 bp, Homo sapiens
ttttttttgagacagagtctacctctgtcacccaggagttcaatggcacaatcttggctcactgcaaccttggcctccagggttcaagcagttctcctgcttcagccttctgagtagctgggactacaggtgtgcaacaccacacccagctaatttttgtatttttttagtagacacaaggtttcaccatgttggccacgctggtctcgaactcttgacctcaactgatctgcccaccttggcctcccaaataaccttaaatcttaaggttgatgcatgcctcttaatctcttggtttgcccatcagaaactgaatcatgggctcactaggagaaattgtcagtttaaaaatcctatgcttttcaaagaggttttattttggataactgttgcaattatagacctagagaagacatttaacccacccatgtttcagtttctattttcttcctcactagattattttattcacttttcaatttttaaaaattagatttattgcagactggcctcaagctcccagactatattttttagctgcattatttaggggttgaaatgccagcttttgagacttttgaaaaattcacaggctgggtgtggaggctcatgcctgtgaaggttgcagtgagctgagatcgtgccactgcactccaacctgggtgacgagagtgagac

SEQ ID NO: 84220 - DNA, 743 bp, Homo sapiens
acattcagtctcgaggttttctgctgacctatattccagttcactaataatgcttttcactgtatctaatttgcttataaatagaaaaccattgattgagttattaatttcagttatagaatagccagtgtagactccaatgcttggctccacttctccactttttcacctatttttttcaccatcttccattttcttcaacacaccagtcagagtcatttttaaagacattttaaacacctcagtggcctgtagatcttatcttctgttttttgtttctttttaatcttagttttttggcacacttggagggttttgattgaatgctagacatagtattcaggaaggcagagaggatttttttttaagtcagattttttgaggtataatttaatacagtaaaattcacctattttagttcagttctaagagtttcctctgtgacttttcctttggcccatggtttatttaaaattgtgttcttttacttccaaattatttgggatttttctagatatctttctgttcttgatttctggcttacctctatcagggtcagagaacaaacttaatatgatttcaattattttaaatttgccaatgtttattttatggcccagaatatggtctatgttggtgaaagttcaatttgaacttgaaaagaatatgttttatgctgttgtctactgaaaagtctatatataaaaaatagattaataaactgattaatagcctggttcacc

SEQ ID NO: 84221 - DNA, 353 bp, Homo sapiens
acaagatcatatcaatgcaggaaaaacatctgacaaaattcaatatacattcataattaaaactatcagaaaaaatatgaatacagaggaacttcctcagcttgataaagagcatttacaaaaaatctacagttaacattatacttaatgatgaaagactcagtgcttttacccttagatcaggaacagggcataaggctatccactcttacctctcttattcagtacggtgctaaaagttgtagctactgtaataaggcaagaaaaggaaataaaaggcacacagattgggaaggatgaaataacttcctattttcagatgacatgactgtctatatagaaaatcctaagga

SEQ ID NO: 84222 - DNA, 284 bp, Homo sapiens
ggggggcatttggtattaaaagatctagaagataaggggggaccagccaagccatctgaggcaagcagcgcaacaggaagggtgatgatgcagaacacgctcacggaagaaagcatgacgtgccacgtcagtgcagcccacgggggcagcaagacaaggaccaagaactgatgcctgggatgtggcaagggtggctttggtgaggtggtggaggtgaggactcagcacccagcatctaactgaccccacacttgtttgaagagtaaataacaaggccaggtgca

SEQ ID NO: 84223 - DNA, 463 bp, Homo sapiens
attaccttaaaaataaacatggctgtatcatcttaaaaaaatcaaagctagaagaataaaattcacctcaatccccttcagtacaaaggaatagtcatactaacactctggtgtttcttgccaggttactttcgtgcatatatattttaaggtatttattttcatagttaagtatttatttcatagttaagatcgtggtaagtattctattttatttcgtcacttttagtatttaccgttataatgtaagtgtctttttccttcatacaaatcatgcttaacaccaatataaaattccatcatgtacctcaatcatattttattgctgtttacacctatgttgaagtttattttcaatgttgtcttataaataatggtgtttagaataaagatctgcattaaagcttttttcctattttggatttttcccttaggacagattctcagaagtgaaatttgagga

SEQ ID NO: 84224 - DNA, 717 bp, Homo sapiens
acaaaggaactaatctctttattcctcttgactaacatgttgaccttcataacacacttttattccttcatcctccttgcctatctcactctctgaagtccctaacacctgtccccttgagtcacctcttacatcaactacttgcacacaaatcttcatctcaggctctactttgggcctgagagagaagaaacaagggaatagaaatacgaccaggagagtgtgttattgcagaagtaaagaggttatgtccagaaggaaggagtgggaaaaaaacttttgaatgctgctgagaggttaagacaagaactggtttggtgatgtagaaatcattggcaatacccattagaatagtgagtgtgtttgctgagaatgatggtttcctgcttcatccatgtccctgcaaaggacatgaactcatcctttgttatggctgcataatattccatggtgtatgtgtgccacattttctttatgcagtctatcattgatggtcatttgggttggttccaagactttgctattgtgaacagtgccgcaataaacataagtatgcatgtgtctttatagtagaatgatttttaatcctttgggtatatacccagtaatgagattgctgggtcaaatggtatttctggttctagatccttgaggaatctctacactgtcttccacaacagtcgaactaatttacactcccaccaacagtgtaatgga

SEQ ID NO: 84225 - DNA, 420 bp, Homo sapiens
ccttttctgtgcaaacagctcagcttgctgactttgatgcagtggtttaggccaagctttgaagtcagcccttggaggacgttcctatcagcctttgcacagatatctcccactccaaccctaagactcaatgccacctcaggactgcccctatccgcagagcttgaggcctttaggtcagccttgggaagaggtgcttgagtggggtggaagaagcccactcttgggaaatggggagcataggggaggaggaagacactgccttggaatgacactcccagagacctctgctctgcctacctgcattctgctgaaggttttgggtcaccttgttttatggtccctgtcccagcatgaagcttgcacaggaagaacagaatgaatgatgtggaaatctgttagcagtggtgtcttccagat

SEQ ID NO: 84226 - DNA, 429 bp, Homo sapiens
gggcagccctaagagaaggccccagccaagcataagggaaggagggagtttggatcagcacatcccttgaggggagtgtctgagccaaatgctgaatgctgggtaggcatttacctagagacaaagtcctggcaacagggaaagcttggaggacagagccctggtggggcagcagtgtggagcagagatgagccagactgccctgaacagcttgagttttatcctgagtccatggggagccttcagagtggttttgattatttatttgtttgcttgtttgttttgttttatgattttaaccattttaagtgttccgttcattgggattaagtacattcccaatgttgtgcaaccattactactatccgtcgccagaacagaacctctgtatcctttaacaacccccatctcctcattctctcagcccct

SEQ ID NO: 84227 - DNA, 368 bp, Homo sapiens
tgggatagatatacactgctatagaaagacctgtatgaaacactgttaagtaaaagaagcaattcgatatacataatctgattaatgataaaatattattgctatatttagcattggtgctaaaatattaatagtaaaatataaaatgctgtttattatttacatatggcattgttacagaaagtcctctaataggatacgtataaaaccaaactgtgggtagtggactacctattgaagttggatgagttaagaggcatgcaggaaaatataactttttactttctatggggctacatcactttaaatttttacaataagcataaatttatatattatttgtacagtttaatcttaaaaatcaattc

SEQ ID NO: 84228 - DNA, 4662 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttcaatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggggacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgaaagtccatgagcacagtcgtccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatttgcatcgcctaccgggacttctatgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtaactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtcatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacatcctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactgtccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgcctcagcacatgcgcacacgcacactcggactcacacgaagtcacacgcacacatgcacgcacacacacatatggggacctgcgcacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatat

SEQ ID NO: 84229 - DNA, 4508 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttcaatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggggacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgaaagtccatgagcacagtcgtccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatttgcatcgcctaccgggacttctatgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtaactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtcatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacatcctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactgtccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgcctcagcacatgcgcacacgcacactcggactcacacgaagtcacacgcacacatgcacgcacacacacatatggggacctgcgcacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatat

SEQ ID NO: 84230 - DNA, 1269 bp, Homo sapiens
cagacgcaggtgtgttgggacggaaaaaaaatgttgagaactaccgaagtaggataaggaagtattgccaaacacatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgcctcagcacatgcgcacacgcacactcggactcacacgaagtcacacgcacacatgcacgcacacacacatatggggacctgcgcacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatat

SEQ ID NO: 84231 - DNA, 4595 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttcaatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggggacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgaaagtccatgagcacagtcgtccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatttgcatcgcctaccgggacttctatgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtaactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtcatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacatcctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactgtccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgcctcagcacatgcgcacacgcacactcggactcacacgaagtcacacgcacacatgcacgcacacacacatatggggacctgcgcacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatat

SEQ ID NO: 84232 - DNA, 396 bp, Homo sapiens
tgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaaccct

SEQ ID NO: 84233 - DNA, 3825 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttcaatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggggacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgaaagtccatgagcacagtcgtccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatttgcatcgcctaccgggacttctatgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtaactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtcatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacatcctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactgtccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatg

SEQ ID NO: 84234 - DNA, 442 bp, Homo sapiens
acacaggaagacttgcaatctggtagctattgcttctgtactacagataaattaaaaacaaacaaaatttgaggtcagcaaaactgataacccttgataaaatttccaaagttctcttacatagttcaatgattttcttaactaccttctcaaggactcccataaattaatccgaaataactgtttgaatactatttatctcaatatctttgttcttgtgacttatcagagaatgaaagatggtaaaaagaacaataatatcttttaatagtcttcagagtaattttaggagatgaaatataattttatgactttttttactttttacgaacatatggagatatatacacactaatacaagtttcaaatgtattactgaataactgattaaatgtgggttttgtttacattcttttaaatgagaattaaggaaagaaaaaaa

SEQ ID NO: 84235 - DNA, 175 bp, Homo sapiens
  misc_feature (2)..(2): n is a, c, g, or t
  misc_feature (173)..(173): n is a, c, g, or t
antcctgaacatcatcataaaaagacagtcaccagtcctgctcatctggaggactgttctcacaatcttcagcaaggagataaaacagagtactgcagagatgaagtaacttgccctaagacccatacctgagtataattttctgaatgtgcagttcaaccacttcatactgnag

SEQ ID NO: 84236 - DNA, 1701 bp, Homo sapiens
ccgggttcggtgctcccgcgggcactggttctcaaagccttctccagcagctcgctggacgcgtcctctgacagctcgcccgtggcttctccttccagtcccaaaagaaatttcttcagcagacatcagtctttcaccacaaagacagagaaaggcaagcccagccgagaaattaaaaagcactccatgtctttcacctttgcccctcacaaaaaagtgctgaccaaaaacctcagcgcgggctctgggaaatcgcaagactttaccagggaccacgtcccgatggggtgtcagaaaggaaagccagcttgccggccgaatcgtgcaggaaaatgggtgtgaaacccacaaccaaacagcccgcggcttctgcctgagaccccacgccctctcggtggatgatgtgttccagggagctgactgggagaggcctggaagcccaccctcttatgaagaggccatgcagggcccggcagccagactagtggcctccgagagccagaccgtggggagcatgacggtggggagcatgagggcgaggatgctggaggcgcactgcctcctaccccctcttccacctgctcaccacgtagaggactcaagacacaggggcagcaaagagccactccctggccacggactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccaaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagtaaaaatgttctt

SEQ ID NO: 84237 - DNA, 1370 bp, Homo sapiens
tacttttcctcacaggtgaagacactggtggaattcctcattgataactgctttgaaatatttggggagaacattccagtgcattccagtatcacttctgatgactccctggagcacactgacagttcaggtatgtgtcgaccctgcagaatgactcagcctacgacagcaacgaccctgatgtggaatccaacagcagcagtggcatcagctctcccagcaggcagccccaggtgcccatggccacagctgctggcttggatagcgcgggcccacaggatgcccgagaggtcagcccagagcccattactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccaaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagtaaaaatgttctt

SEQ ID NO: 84238 - DNA, 1194 bp, Homo sapiens
tacttttcctcacaggtgaagacactggtggaattcctcattgataactgctttgaaatatttggggagaacattccagtgcattccagtatcacttctgatgactccctggagcacactgacagttcaggtactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccaaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagtaaaaatgttctt

SEQ ID NO: 84239 - DNA, 594 bp, Homo sapiens
cccggctggccgaagaggagacccgtttcctctgactgagagacgtggctggggggctttccatctgcttcgcctccctcgggcaggcagctctgagatgcccggagggatgtgatgccccatcgccaaattggggtctctaaggtcagggccatgccttcccctcagactgaggcggctgagggcagggtcctcaggctgatggctgtgggagtcgtgccacgcccctcgtgcccccgggaggcccggccggggctgggtggggggatccggtggttccacatggtgcagttctgcgctttggccaccagatggcagccgaagctaagggatggggctgccgtctcccgtcttgctgtccttgtcccggtaagaccggggaccctggaccagggaaccgacggagggccactcccatgtggatgcccaagggaccaacccaagaaagatgccgcccttatcctcctccactccccggtatgatacatgcccctgccagagagggaaagaatctgcctgctcccctcccactaggctcctctggtctgtaccctggaaagaaagaggtggcggactctgtcactgagatccggc

SEQ ID NO: 84240 - DNA, 561 bp, Homo sapiens
acagagggacagactgctgaggaatacatgtggattctttccttctgtgacactctgaaagaattgtgactggggcatggggtgccaccttcagaggcaggagtgtttaggaaatgccacagtggcacatgacctgcgtgggctccagcagcagcagcaacctgcagggtagatagggcagctgagaacacgagagcagaagggcggtgactctatcatctcggagggttctgttcaaacaacattttctagtatacaatgaaaagagacctggtgccaggcatggtggctcatgcctctaatcccagcactttgggaggccgaggcaggtggattacctgaggttgggagttcgagcgagaccaggctggctaacgtggcgaaacctcatctctactaaaactacaaaaattagccaggattaggcacgcgcctgtaatcctcagctccttgggagactgaggcaggataactgattgaacccaggaggtggaagctgcagtgaaccgagatggtgccactacactccatcctgggtgacacagtgagactctcaaaaaa

SEQ ID NO: 84241 - DNA, 355 bp, Homo sapiens
ggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggtt

SEQ ID NO: 84242 - DNA, 321 bp, Homo sapiens
gtatctcatgacttctttgaacctcgctgaataattatgtacatagaaatcctgtttataatgagaaaggaagagcaacccctacagctgtcagctggaactgagtattagccctaatggctaggctattatattctgttgaatataaacaatgttatataacaccaacatctgacaagtccactctgagtgtggtggaggaagacaaaaattaagacactccataggcatgttggaacttagcaagattctgtgtaaatcatagagcgaccaaacattcttgtctcttggcttatatgtgtgatatttgctccattaccc

SEQ ID NO: 84243 - DNA, 362 bp, Homo sapiens
tctaatcttccgcccaagtcagatgagaggtagagatagaagtctaggaatctttgtcaagcagtctttgtcaaattgcctatgggacatagagcatgaaaagtggggataacaagagaggtaaataaaatatatagacaggctgccaagaacaaattgttagtttgaaaatgctaagctgaaatgtaacagaaaccggggagacgataagcctggagaaattggccaggggtttgtttttttagggacagttgtgcacagtgtaaagacatatgaacatgaaggagggaatcctcattaccttagctctggctgatgactttcaaaaaccatagatggaggcatcacatttcctgatttaa

SEQ ID NO: 84244 - DNA, 658 bp, Homo sapiens
agcgccgcccttcctacggctacgggaaggatcgtccagtggctgaggctggacagagcacaggaattcctggttgtttcatgaaagggccgtatattcaaagtgacctccaaatacagaaggagctgagaaactaaagaatgaaggagacaaatccagcttgtcagcaaaaggtgatttattagggaacttacggacagaagcatggtcttggacagcagcaagacaggaagcccatgccatgtcctgaggacgggtgagcagcctggtggagagatctatctggtggggaactgagactgcctgcagtcatgtgagggagccaccttagaggcagaccctccagcctgagtcaagccttcagatgactgcaggtgacatcttgaccacaacctcaggatcaattctgagccagaaccactcagctaagccactcccacattcctgtcagaaactgagtgacataatgactctgtggtttttaggctgctatatctgggagcaatatgttcaacaggagtggtacctaccttgagtattaataattgttgagagtcacctttctcaccccttcacttgatggcgctgtggtgcaactgcaaactcctgtggcaacgacttgtctcgctgtacagcagacaaaagataaaaagcaaga

SEQ ID NO: 84245 - DNA, 431 bp, Homo sapiens
gtacttttagtagagatgtggtttcgccatgttggccaggctggtctccaactcccgacctcaagtgatcgcctgcctcagcttccggaagtgctggaatttcaggtgtgagccaccgcgagcctgggcaacaagagcgaaactctgtctaaaaaaaaagaaaacagcaaaaagcaacagatataggatgatcccttttgtttaaataacataactatttctatacattgatacacattgatgcatagaattaaaatctaagctgggcaggcagctatagtcccagctactcaggaggttgaggtaggaggattgcttgcgcccaggagttcaaggctatagtcagacatgattgtgtctatgaatagccactgcattctagcttgagcaatatagtgaaaccttattgctacaaaacacaaacaaacaaa

SEQ ID NO: 84246 - DNA, 466 bp, Homo sapiens
gttgatgggaatgatgatgattataaattatattgtgcaattactgccatgccttgttctaatgcttaatgtggattatctcttttaatccttagtaactctataacaaagatactatcattatccccttctcatatatgcttaacagttttagctttgtagcttctttagtttttttcctccttcaaagccataaacaggcaattgttaaaagaggaaaatacttctctatgtaaagcttttttttgagaacaagagcttttaaaaattaataaacacaagtataatttatttataaaatgtgtttgtggaaacaatactgaagtgctattaaaacacgtatcattatagatgctgattttgtcatgcccaaatctcattgctggacagaatttcaactattccattgctgtcaggcattgtttttgtttttctaagcaggaatctaaaattccacattgaaaga

SEQ ID NO: 84247 - DNA, 728 bp, Homo sapiens
gaagacccaatgtcagtgtctggattctagaagaccattacagtttgactccgcaaagcttacccacttctgattctagaaggggctgccagtcatcgtgcctgcccgtggctatagtgatggttgcgggaaaagtacctggcccggcccatttaattttgtcattaaactaatggaagcaacaaaaaaaaaaaaaaaaaaaaaaaaaaaaaaaaaaaaaataaaaaaaaaaaaaaaaagaaggaggggggcgccgggcggtaagataaaagagtatctctctccgagagggggggccacaactagtttgcgggatacacacatgcttgttgttagtaaaacagggggtcgcccccatatatatggaggctgctttatataataatagaagcagtaggcgacggtggcgcgggtgtttttacaacaacagtcgtctactaggcagctagggaagaaacaatgcgtggtatcacgaagtgaggagatatcttgtggggggagagaagagcgacccactctactcctgtggggggggggggggagcacaattatgtgggggaacaacaactccctctcattgacgagaaatatttagaagccaccctacgagggggaataatatttaacaattttttagaggggtgtactacgggggggtctactaaccatgaggtgataatttattgtgtgggggtgtaaaaaagttttcgctacaagggaatatttta

SEQ ID NO: 84248 - DNA, 464 bp, Homo sapiens
ttgaattttcattactagacaaacatccatgcattttttgccctttcttctttgtccacatctttttcctacaggctgaaatgtgacaaaatagttggactgaaacagttactttggcccatgagatgatcttgagattggaggtcacataaatagtagagcagcaagagatagaattcatatgcttgaaacattcatgggatccagccctatgcaagtcctagcctgcataacttcagacttttatgtaagagagaactaagcatacctcttctgcaagtaacagtcattaggtgcctcagcaactcaaaaggaacctcaccctatatagtaagtgtgaataagttccagtgtgtttgtttaaaatatatacttttagaataacagtaaaaactcaatgtatagttttagaataacagtaaaaacagaagtgttttgtaatttaataaactcagttatgcttt

SEQ ID NO: 84249 - DNA, 562 bp, Homo sapiens
tatttgattaaatgatttgtctctggtttgaaagtggaagcctgagttgagccaaatgcacaaacagtccctagtgtcttctcttgtgttaacgccacactggaaatttccctcgctccctcagatacacattaaaggaaataccagggggaaggattttagcagtttcttggtcatttcaatgatttgagatgtggttttttagtctgaggcaagtgaggggggtggagaggagactgggttcttcaaagttcctaaaatgtgtatttagatgagtctgtggttaaacctgagctgtgtggtcttctgtggtctgccccaaactcaagtgaatcagttcctgctcttcacgaccttggggatccggcactcaggccatgaggcagagactacggtgcttcaacattcaagtgcgcctctaagctagagccttaaaaaccacacagctcaggctgaactcctgtcagatacttataatgttctcaatgtcaagatgttaaaagtatatttttcatcagattttaaaaataaaagcaacatcgttatgcaaaaataaaaaaaa

SEQ ID NO: 84250 - DNA, 566 bp, Homo sapiens
ttattgaaatagctattcccattagtttaatatatcgtccaaggctgcttttgtgcacggtgtggcaggattgagtagttgtatgagagactctacaggcagcaaagcctaaactgtttattaacctgtcctttacagaagaagtttgccagtcctttttatttaatgtgattattgatatggttggttttaaatctcccatctcggtgtttgtttttttacttgtctcatctgttctttatttttcactctttttctgctctcttttggattgaatatttttattccattttatctctattactggcttattagctatacatctttttctctgactttcttaatatactactacttcttctacagtataagaaccttagagtagtatgctttaatttcttcttccagcctttgttctgttgttgttatacattttttcttccacatgttagaaatcttacaatatgttgttacttttattttaaactgtaaaaaagaaaaaaattatattgatctacatgtcattgatgatagtcttcatccctttgcgtagatgtgtatttcca

SEQ ID NO: 84251 - DNA, 671 bp, Homo sapiens
aaaggatattgtccatgtcatgaaatattgacaatatgataaaaatgtttgctaaattagaaaaggtgatgaatttggaggaaggggaattggctgcacctgtttctgatatgttcagaagcttaatgaatataatattctaatttaaataaactgtttgattgagaaaagaggtagccacattattgtttagaaatgatagactgttattgacttttggtgtagctgggaagctggagaagaggtagtatgtagtttgcttttgatttcaaaatgccacctcttctgattccagatacaattatcttttggcacatttcctaattagcattaggttcttataaatgaaattttattttacacacagtttttaatggaacttacttttgaacatcacgaaagttatctctagcccttttcatgccttaggtgctgataagcattccgtttatcataagctatgtcattagtctcagcttcctagtgggaagtaaaactcatagcaattctctcagtcatccatgatatatagctaggtggggccagatgatttgaaaattaacatattgttcattttaggtgctttgttttcattttaagttgtttctgcatctagtttgaagctgcttggcataaagatgagcctttctgatagaagtgtgtgagaacat

SEQ ID NO: 84252 - DNA, 168 bp, Homo sapiens
ccaatgagtgtggaccctaaatttaaacagctaaagctatagtctaaggacagtctcaaataaatacctttgaattgtcatatggtgcccaggagggtcttgtggaaagggtttcatggtagtgaaagatgtaataactctttttttcttttaaccctaagactgtgc

SEQ ID NO: 84253 - DNA, 128 bp, Homo sapiens
taagtcagggcaaaaagggtctgaaagctcactcttcactgagatcctacaggagtacatagtcaaacaaagaaatctgtgaattagcaacttgcataggatagcatctgctctggataggaaggtct

SEQ ID NO: 84254 - DNA, 406 bp, Homo sapiens
aagggaagtatttctcggaagaggtgctgatgggccttcttttcagatggtgaggcttctgcttacatcttttttatgtctttgctgtttgggacctaattgctactttttctagtcgtagcagatgacttgcttgaagctgttggaatagttactgcatattgcatacccttccttgtagctaaaacaacaacaaaacgcagtgtgtgtctaatattggacaagactctattgtgagttagaaagcagaggttttctgcttgtgaactcctttctctgatattttctattttgtggtaagttaggcttggtgtaagttgataaccacatctcatttaaccatgtgcgtcagattttgcatttttgagctttagaaactcaaaagttttcatttggggaaaaaaaa

SEQ ID NO: 84255 - DNA, 338 bp, Homo sapiens
caatggtgtgatgttggctcactgcaacctccacctcccaggttcaagcaattctcctgcctcagcctcctgagtagctgggattacaggcacgtgccatcacgccaggctaattttgtatttttagtagagacagggtttctctatgttggtcaggctggtcttgcactcccgacctcaggttatctgtctgccttggcctcccaaagtgttgggattagaggcatgaaccaccacgcccagccaaagttaaactattattctgtgtcagaatctgtattaaatgtgacttgtcaagttattcagtctttatccttaaataaatgagttatctgaat

SEQ ID NO: 84256 - DNA, 331 bp, Homo sapiens
accacacccagcctcattctcttattgaacctttatcaaatcacacttcctaaaaaacagagtcataaaagcagaattactaaaccaaagggtagaaaggttatactgctttaaatgacacatgaggagcagaagcccctgagtactatctctggtcaaatattctttaaatctttgcaaatttaatgcgtaataaatagtattactgctttacatgtacactgcattgttagccagtgagtttgaacatttttttcatgttcacaagctatttaaattttaaattttgttggtgatccattcaagttagtccattttcctaacagactta

SEQ ID NO: 84257 - DNA, 530 bp, Homo sapiens
cacaatgaggggcacatttgatgctgctgggcagggagagagcctcacactcatccatgggaggagagcgcccagaggaggtgggctgagctaagatctgggtgatgcactccaagagaagctttggctgcaggtgagagctgagctcccgtcacctgcctttcctgtagaacaggcttccagatgctgcacaaaattcattcagccagtgacacctaattccagatcctgactccagccctgcttaccctgtgatcttggcagttatctctgggtcccatctgcttcagtcataagatggggtcctcattcctgcccctttagagggagtgtgtgcatggaatgacattccaaaactgcacaagtgcacaagtagccctccgacttctggactaggctggccagtgccaggcagtagagccctcggagggtttctttcagaatctgagcaaagcagccacaagtcattacgaagtggacggtgatggcagaactgatttggtcagcgtgaatcatgaatcagccattcg

SEQ ID NO: 84258 - DNA, 516 bp, Homo sapiens
tctataaatatttgtgacatctgtgacatttgtttgccaatcttttatggataatttatttgtctatgtttagatatattgccattattcataaaagatttagaggtgatttagatattagagttctaagttcaaaataactattactaatatttttaagaaaagagagaaaaagattttttcatgagataactacaattcataaaaagaaaaacagacataaaactaaaaaataaactgaactgaaaattcattaggtaggctcaatagcaaagtccacaaagcagaagagataatttataaactgtagtcttgttcagtagaaagtatggagacagaagcacagaacaaaaaggagggaaaataaagaaatgagcataaaagttcaactaagcaaaaaggtctaaatcatggatagtcagatttccaggagaaaacaataaagtaaaagagatgcaatatctgaaaaaaatactagctcagtgaacaccgatcggatagctaaaacaaacaaat

SEQ ID NO: 84259 - DNA, 353 bp, Homo sapiens
tccctttacactgtccaattgtgcttcttacttttttttcatgtatttacaaactctagttaggatcctgattacagcatagttccttgataatattaagatatgtaaggtatcttcattgttggcctcaggctatctttgctatgacttgcatttgtccaacgtcaaaacataggaaacaggtaataaagcttttggtggtatccagccactgtaatgaagacaggaatgtgatttgagctgggaggaataaatttccatcttacttcacttttatattcctttttattatcaggcagcattacccaaagccatgggttttgttttcagaaaagtagaacttagaattatgc

SEQ ID NO: 84260 - DNA, 997 bp, Homo sapiens
caaacctctcttggtgggcaggcagtcggacgctcagcaggactggcaaaacagaatatctgtgtgtcagtgtacgttttattcatctgtcgtttgggtcagggtctgcggggcagatccccgcagctaatgccctcttgtgagcagcaatacctcactttttatcagcctctggctgcagaagagcaggaccacaatcctggaggctcagcaaacatcccatcaatggtggaaaatgtttcctcttcgtcccacatggagtttacagatgatgggtttccaacttccagaagaggaaccagctgaagagaacatcccactccccgctccccaccacaaaaaaaagattcagagggtacatacgcaggtttgttacctgagtagacttcctgatgctgaggtttggagtacaactgatgccgtcactcaggtacagagcaaaacaggttggagtgcagtggcgcgatcttggctcactgaaacctctgactcctggattcaagcaattctcctgcctcagcctccagagtagctgggattacaagagcccaccaccatgcctggctaattttgtatttttagtagaaatggggtttgccatgttggccaggctggtctcgaattcctgagctcaggtgatccacctgccttgacttcccaaagtactgggattacaggcgggagccctcggtgtccagcctagaatatcctcaaatccttccacagtgaccccagtttttatttctacctttctgcattctacattttctttggtacttttcttgagcacacattcagtctggtattagtaacttccacctgcattagccccgttcttcagaaaatactaaatgtgcagtcccacagaagcaggagtaagtgaaagagaaacaaagtggtgaagaggggagagaaacctcacagggtaggttcctgtatggccagagtctgggacaagccaatttcgtgatttcacaggatgccttcagagagaaca

SEQ ID NO: 84261 - DNA, 641 bp, Homo sapiens
cagagactgagtgtcgctgctgaaggctgtggtggaccgggctggatcgcggattctaggagccggtggttgggggtctgagaagtcaccaccaccaagaagttcttcggcttcgggagccgcgggggcgagatggcccgggctccatagaccacgtctgcacggttccgggtaccgaatccgggacgcggaacagcggaaaatccaagggcggctgtcaaggaccggaggtggagcgcggcctggagcgcaggagccggagacctggaggcccgggacaagcagcacagaactgctctacatttggcctgtgccagcggccatgtggaagtggtcactctcctggtgaacagacaatgccaaattgacatctgtgacaaagaaaagagtgtgcctttgatacaggcacaggctgtgcattgccaagaagaggcttgtgccattattctgctggaacgtggcgccaatccaaaccttaaggatgtctacagcaacactgctctccagtatgctgtgtatagtgagagcacatcactggcaaaaaaactgctttcccatgatgcaaatactgaagcactggacaaggtttattcctttttttcctaattagtgtaaaacaacacaagaaagaaaatatgccc

SEQ ID NO: 84262 - DNA, 392 bp, Homo sapiens
tttggggaaaacacctgcaatctgatgtcagacttgaagtattcaaagtagttacagagtagaaacagagaaggttttctttcaaattttaactcaaaatagcttaaacaaaaccagaaaatgtagtgtctcaagttatttcagatataaatgaattcaggaactcacaggccttactggtggtccctaggaaaatctgaatccgtttctatatttttcagcaaaaccataagaattactgaccttgacctagcttggctcctatgccatctctggatcaattccttttgatcagaatggaatgaaatgactggcccacctgaatcctgtgcccaccccacttaaaacccagagactgcaaatacagcatgggtggtctccaaagaaaaatc

SEQ ID NO: 84263 - DNA, 620 bp, Homo sapiens
gggagaagaggcaggtgaggggataatgagtttggtggctgctgtgggcagctgaacagaaaaactcaggcactcaggctgtttctctcctaggcttctgctagtggaataagctctgggcaggtgcacctcctgctgctggtggtggtggtggtgaaacaaatcctggcccatgtccatgacgctgaggccccagaggcctgatcctccagcctccagggttctaggacagttgaaagcatccaatactggagaaactgtttgtgatagagtctgatacatgcagacacattccacatgaggtatgggcagaaacagggcccaaaaaggtgactagcacccactttgagcctactgggacagaagcagggcttccgccgatgtatacaggagggtttggtagacggctgatggccaaggctaagaggaggaccacaaatctggaccctccccatcctgtcggagctccacaggaacaggtgcccaggcaagctgctgtttgagcacacaagcccaggacacagggcaggtgtgtttcccagggccctggcccagcagtgccaagccttgtgccttgtcactagtgattatggcctgggtcacatctcccacacacacga

SEQ ID NO: 84264 - DNA, 518 bp, Homo sapiens
acaaccaaagctcattgagcagctactgtgtgtccttggagttagaactcaaggatggaatgggggagggggatggctgcaaaatggtgtaaaaagaattcaagactggcaggtatcatgctggacccctgttgacttcattcaataggaatggcatcgtgtttgagaggctaaagacctggcaccagtgaacaagacatagggtttattgagggaacttacatacagggcagtcccgtccagtggtggtggactagacaggagaactgtaacaacttgtataaagcatgcagtttatatagtgttttcacttaacaccctcctcctaggaacctctacccattaaccttcacttaacccaaaacaaagagccttgatcctctgtacagcctgtgctccacaggatgggccaagggataaggaatgaatctccatgttggctacttctggattccttagcttacagctacaaacacacattcttcttagaccatagggtcattctcagagtgtgccta

SEQ ID NO: 84265 - DNA, 333 bp, Homo sapiens
tagatgggaactcactcaaatggaaaaaggcatctataaaaacactacagttgacatcatacttaatggtgcaagacttgaagcattccctctaagctcagaaaaaaggcaaggatgtcccctctcaccactccttttcaaaatcatactgaaaatcccatcttatgtgataagacaaggaaaggaaacaaaaggtataccaattgggaaggaagaaataaaactgtttttgttcacacatgacatgattgtctatgtagaaaaattccaaagaattgattgttttaaataaaatctcctggaactaataagtgataatagtaaggttacagg

SEQ ID NO: 84266 - DNA, 362 bp, Homo sapiens
ctataacaattgcctccctacctttatctgagcatttggtctcactctcttgccacactcccagtctttcccctgtatggcctcagtgatatttctaacaaaaaactctgactatagtattcccctactcagtcatctttaatgattctccttcacctcttgagtaaaatctaaatctttttggaagggtgtttgaggttcctcatggttttgtccattgggctggactaaggttatggatgagagacttgtgaggaagaaaaaccagttctagagaaataaaggcatggcatctttgcacacttacaaatgcaggaagagaaggtttaaaaccatctttctagaatatgccctttggctgg

SEQ ID NO: 84267 - DNA, 714 bp, Homo sapiens
ggagatgttcagctgtggattcagaccattccttactagattcttccccacctgttcttgtcaccctcccatgctcaccaggctgtgagcagagagaatgtgaacatctatttaagaagaaaggcgtgagggaaagcatgaaaaatccaggataaaatcatcatcagggaaactcctatgatgctggaactggacaacagtgttttagatccctagtcatgcccattccttcctgtcctggaaaagttaaaatatgaagtgcctgtgttcactaaagcaaaaccttctgaaatagcttacatggatggattctttagaattggatgaaactctttggttacccccaaatttcttgaaacactcaaaacttccattagctgaggtgaagcctctagtggttcaggactgggttctacagcaagggttcttaactcagtccatgaatcttcccaggaagtctccaccaacaaaattcaggaagtttgtgaatatcctgaaattttatgaaaagtgattggcttgtgtgaacatgctgtttaactgggaagggaatctttagctttcagtaaatgtataaggtcttacagtttgctctgagggtactactgctccacatttctcagctacaaaattgaggtaatggatcctgaatcactttagtcacgcagagtagcctgtctttctgatcacgatgagaaattcaaaactgagccc

SEQ ID NO: 84268 - DNA, 222 bp, Homo sapiens
ccttgcttgtcattggcaaacttccaaatactttcctttaagtgattctgagacccatatatcaagtttgtttttaaaataaatgtattgaagcaaaaaaaaattaagtaaatgtaaagaagaacacatttaatgagatatagagctatggcaaaagtagtgaagtctggaaaatcttaactttacaataaataaatccaagatcattgtaagcattgaaga

SEQ ID NO: 84269 - DNA, 307 bp, Homo sapiens
gaccaattaagagattattgaaaaaattcaggccaaattaacataggttctggggaatgactgaaggtgggggtaaaaagagagagacacctgggatggcttcaaggtttaatgctgcacgactgcaacattaattaatagactgaagatacctgtaaggtctcctggatcatccctcttttatgggaggcaaaacgtctccaaaatgaccacaaggtgcctctgttctttaagagggcagtcaactgtttaacatttttccaaaaatgtacattttacctcagttgataaattatatgtgctcctt

SEQ ID NO: 84270 - DNA, 459 bp, Homo sapiens
cctgggttcaagcgattctcctgcctcagcctcccgagtagctgggattacaggtgcccgccaccatgcccagctaatttttgtattttttagaagagatggggtttcactgtgttgggcaggctggtcaaggactcctgacctcatgatccacctgccttggcctcccaaagtgctgggattacaggtgtgagccaccgtgcccagctaaattttgtattttttagtagagatggggtttcactgtattggccaggctggtcaagaacttctgacctcatgatccacctgccttggcctcccaaagtgctgggattacaggcatgagccacagcacccggccggtatttatgactttttaaagctcatttgttccctaatatatgcagtaacttagattacctagtccactaatttataatgaaaccttgacttcgtagcatgaacttagaaattctt

SEQ ID NO: 84271 - DNA, 286 bp, Homo sapiens
cctcatttggcagcagaagcatcgagtcacaaggaggatgaggttctagcccagaagcagctgggctatgtcattctaaaggtggtgagtaaaatggctattcactggggcatcaggttttctttcatgctatttccctgagtggagaatctgggtctagaagggggtgtgtgtgtgtgtgtgtgtgtgtgtgtgtgtgtgtgtgtgtgatggtacacatgtatggcacttacattttcactgagcagcaatacttgcaaagctgtgagtgcaataactaaacaga

SEQ ID NO: 84272 - DNA, 382 bp, Homo sapiens
aagtgcacacaagaacagagaaaccaaacatattgagaactatgagaaaatgtcgtcatcttacagtattaagaactttatcactttattattcagagatgttgatatctgaatagagaacaccaagaagagtatcaagctgcccacagatgtctcaaaatattttttaaagtaactatggaaatggagaaataaagatgaatggaaacttggccagaagagttagcaaaggtagcaagagaactggcattcggtagacaaaagtaatgcaagtcatcccacttttacataaggtggtcatatactttatccaaagaataagactgtaacaaggtattttcacttctcttaaatgactgtgttaagtagtctctcccttttc

SEQ ID NO: 84273 - DNA, 1019 bp, Homo sapiens
tcactctgattacagatgagttaatttaagtttaataaacccaagtccaagtaacagagaataggaaaggcatagaggtaggagaaatttggaactaatctttgttgtgcacttaccatggtacttgaatccatgcaagatgcttctatataatttatataaattatgacttcataataccctcacaacaaaaatatagccttatgtagatgagggaactcagaatggtctagttatttgtttattgtcacataatcagttaaaatagcacaactgaaattcaatacaggttctgttggcttcaaacccatattctttccctactcacaaaaatccacttaaagtcaatttcctttggcttttgctattcctagaaggacccagactactccttcagttttgagaattactgtctaaggaagcaatgattcttccctttataaaccatctgggcagctactattttctgatacttacaatgaccacttctttttgtgatttatttaggatgttttccaaattgcatattagtagccactcacaggggtaaatgaaggctcatcaagtagtgaaaaggcagctgttctcaatttgctggctgccactggaatcatctactgacctttaaaaatgttgatgcctgcttttcagccccacaaattccaatttaattgattggggtatggcagaggcgttgggattttaaaacactacctaggtgattttaatgtgtagctaggctgagaattattgttttttaaggatcaagatgagaatataagtatttccataaagaagtaaaagaaataatgttactatttattcaacaagcccaactttttgaatagctgctgaatttaaggattttttcagatggaaaataaacaatttaaagtttgatatctttttctatataaatgacatttgtattcatttggagaacctgtttaaatatgtgcttacttcactagttaagttactgattcatgcttatttaatctgtaaaacacataattctc

SEQ ID NO: 84274 - DNA, 175 bp, Homo sapiens
tttcttgggcatcatgaatgattttcttatcgacatctttgagcacatcaccaccaaggctggctgccaggttgctacactgagtgctccactatcacctccagagagatccagaccacccgagcctgatgctgtctggggatatccacaaacacgctgtattgaaaaccaaagg

SEQ ID NO: 84275 - DNA, 448 bp, Homo sapiens
ctgggtaggatgagcacctagttgtgtgaaaataaagtgtgtggtggactctgaaagccaaggaagttgcaatctctgttctagaagtccactgaagaggcagaatgggaattagttccttgaggatggtaggtgtaacatgttttaacaaggtggctgaactactcaaaagaatacagccttatcagaagccaaacacattcactaatgaccctgctgatgttcctagttctaggttgtttggtgggtcttaaaactttaaatagccctgcaaggggatgtggtaaatccacatgacccctctctgttttgacagcttggccctgtccaaatgaatcttagtcaccactttggctattttaggcccaagtctgattctgtggccccgggagaagtacagcatgtgtttcttgtgatggggcaagcccaagctctctggtgaaatgtt

SEQ ID NO: 84276 - DNA, 344 bp, Homo sapiens
ggcttttcacgtgagtgcgtctaagccatgtaagaaaaataaatacaggccaggcacagtggctgacacctgaaatcccagcactttgggaggccaaggtgggcagatcacgaggtcaggagatcaagaccatcctgtgaatggtgaaaccccgtctctactaaaaatacaaaaaattagctgggcatggtggcgggcgcctgtagtcccagctactcaggaggctgaggcgggagaatggcatgaacccaggacgcggaggttgcagtgagctgagatcgcgccactgcactccagcctgggcgacagagcgagactccatctcaaaaaaaaaaaaaaaaaaa

SEQ ID NO: 84277 - DNA, 252 bp, Homo sapiens
cgcagagaggcaaacccccaaacaaagagccggcagctcgcgtgcggggctcccgggcgcgtcctgccggctgggctgggagagccggcgccggggcgtcgcggccgagcgctgggcaggcggggactagagggccggcaggaagcctcagtgggcgcaggggcgcgggccgggctgcccacacgctgaccttcccgggctgggagggaggagcgctggctgcgggcggtgggcggctgggcggccccggga

SEQ ID NO: 84278 - DNA, 804 bp, Homo sapiens
agagactgtgggagtctctggccataagcttcccgcctcctggccctccagcctccagcgcactctccgccaccgcctgaaccttcctactccagctcgcagctgtctggagcgcagatcgagtgcgtgaggcgttacgcccagcgctgtgggattggcgctcagctgtgcctcacccgtcgcctcaaggaccaaccggatagcgcggcgtgggcgtgcacccggcggcggcgagtagagggggcgagagttctcaccccacagccttcgaccggagtccgcctccgcccaagcccctgcggatctgacctgagccttcagcccgcagcgcgcctcccttgagcccaagcactgggaacacacagagactgtgggagtctctggccataagctccccttgggtgctgacatgaaacctgtaaacagttgcatcaggagattgttcaggaaactatcttgcgttttcttcctttgctgcttaccaaagcagtctaggcttggactccaagaatcaagacgtcagaggtatactttggttcatgagcatcttgataagactcttgcctgtcatcctgttactggtagaaggtgtccaggttcttggcatcttgaagaaagaattgaagaaaacgcacaaacaaagcaaggaaggaatgaaggggtttattgaaaatgaaagtacactccacagtgtgggaacgggcgagcataggggctcaaaggccgcgttacagaattttggggagtttaaataccccctagaggattccattggttactttgggtatgccctatgtaaaggga

SEQ ID NO: 84279 - DNA, 452 bp, Homo sapiens
cttcaaacatcaatttaaattatgaaaagtcttgagtaattattttgtaccatcttataaaaacattttcatttgtgaatccattcattcaacaaatatgatctataaaatgtgagacagtctgctaaattcagtacattcatagataaattagacattgtatatagctgccctccaatttaatttctatacagacctgttacctacattattatgtgctatagaacagatgctgttaaaatccagttgagacatttaatccatattggaggttagagagagattttagaagttttatagtcaaagggctgaacagccaccaggttggctatggtgagtaagtaatttgagagtggccttagcaatcacctggtccagtgtgctatcgatgatcacccttttataaatctgttaatgcctttttccataacaccttccatactgatttagag

SEQ ID NO: 84280 - DNA, 453 bp, Homo sapiens
tcttataaggacactaattccgttgatgagggccctatgctcatgactttgtctaaacctaattaattctcaaaggcctcacttcccaatactgtcacattgtggggtagggctttaacatatgaaatttgagggaaaaggaatgttcagtctagaacaaagccccatacatttcaaaaagctgtgggacaggagggaatggggatggtattcaatggtaccacatccaagcaagtcttgtatggttaaaacaaatcaatataataacatgaaattttacacagaaacctatctgattataaactgtatgcttaccataatcaacactgatgtacattgttttaaaaatacttaatagtgttctttgtttaaccaaacaatagaggtattaactagtttcctagtgctgccaaaagaaattgctacaaaatttgtggcttaaaatagtaaaaa

SEQ ID NO: 84281 - DNA, 599 bp, Homo sapiens
caaaaaatctcatctgcacatccttcccacccccccaagtgggcgattccatattcttcctgtcttttgctctcccaagaaaatgaagactctatacctttgaggagagatctcttccctcttgtatatggaaaatgacacagattgtttcttttctccttttcctttataaaacagaggaaaatcttttatacaggaagcctctgtcagtagaaatcaggagcattttccagtttcactccttacgtggagacagggatccttcttctggatgttattaaagggaggaaatgggaaatagtccttgatgctttagagattttctgcacgctccatgttgaagcgcttgccctgtttagtgtatgaacttccctgcctcacttttggtttgtcttgggattttattaaaaaactcttctttctttgtttctcaagaagaggcccattctccaaattccctcttggagggaatggctacaaagtctgaatctttggaaaagaaagcccctttctcaaggtgaaaagagtgttgtgagcttctgagggcctggtcattattgtgagtattgttcctgaagcaagcatggcagcgcctagtg

SEQ ID NO: 84282 - DNA, 390 bp, Homo sapiens
gaatgggtatctagataagttaataattcattttttcttccctgtttgccagtgaacaatctgaaggtacagggctgctatatatggttatgcagcttgtatactgcccaaagatgctggactgaaggaagcaacaagtcagcctgtgttctgcttacagagtcctgtgccccagcttaggcctcgcagagggaactgtgcctccacttctctctccaaggcatcagctccttgccaaaagtgtctgtatttccccagaaggatgtatttttcctagttacataaaggccctatggagagcaatggatgctctgaaagactccttaaggagacatattaaggatacatttagaacaacatcaaaaacaattgggaaattggagaaatggt

SEQ ID NO: 84283 - DNA, 2073 bp, Homo sapiens
ttgttttttgtttttttttttgagacggagttttgttcttgtcaccgaggctggagtgcagtggtgctgtctcggttcactgcaacctctgcctcctgggttcaagcgattctcctgcctcagcctcccgagtagctgggattacaagcctgcaccaccacgcctggctaattttagtatttttagtagagacgggatttcaccacgttggcaggctagtctcgaactcctgacctcaagtaatcaacctgcctcagcctcccaaagttctgggattacaggcgtgagccactgcgcccggcctgatgctcctagttttaatggtttgaatgaacaggggacgtgagttcttgagaacagtaactacggtggtgcatttttcccccctgcacgtaacgtacagcactctaccgttttgccaagcactttgtgctcctaaaatttctgttgcattgttgtttgaatgaatgaataaatgagtcttttaaaagtaattgtagaagttgcagcattaagaaataaagaggggggctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacgcagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagcccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaacgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagac

SEQ ID NO: 84284 - DNA, 633 bp, Homo sapiens
attggggaaatgaagcaagaaaaaacattttaaaagtaacatgaaaattgaaatataaaaactcatttcttggctctgtctgccaggccctaagattacctcattaatgaatctattacctaatcagttcaaattcaggaaggtagactaaacacacttggggtgcacagagaaaagagtacctgcctcccagccctgttctacgaaggctgcagaaaggctcattacctgcctccctcaactcaaaccactcctgagtaaggcttctgggtaagctctctgaggtctaagaaagtttggtatatgccttgtctatcaaaatggagctcatagcatgcattagactctgataccttcaggtcataagaagccttactcttcggtcaggacaggctaaggttagccacacaacaggaagtcagtggcagagaaaggaagttaggccagactcctacttcctgacccaatcaaggcagcaaggagtaggaggtcgaactcaagcagaagtatgtctctcacactattgcaaatatggcttctcaatcataatgtagctggggagcaccagctcagctgatactttcccattcccttagtagaacccatctccatctatccatgaggaattacttt

SEQ ID NO: 84285 - DNA, 842 bp, Homo sapiens
ggcaaaaggctgagcatgaaattcctcacagaatccagagggcagtccccaaggctctcagagtcttactctgagccacaggaagaagtaccttacgccagctcacaggggaactccaaacagtcagcaggaagaaactcagtcactcagatgaaaatgatggtgtctcaccattcttctatgcagttttctaaggggcaagacagagacatttggctcttccaatggtgccaggcttccagcaggaggaatagaggctgtggtaaaggaaaccgttggcaaatgaaagaaaccagaaactgtcactacccataacaacgaaacaacaaaaaaatttacagaaaaggaaggggagacaaaggaaattgtttaaagtggttgaagcctgtacagtctgatgtgatcattaggcgtgagggtgccgcagcatggtggtgcctaagacactgactccaattttccagtgagaacaggaaggctttaagcaccaaagccatgctgtccagtaatactgctgagcaagaaagcttttcttgaaggaagagaatagcgtttaattgagactatttttgtcagtctcctaacatgctcctcagaccactaatatgcaaaagaacctaaggatctggtcaccaagttacgtcaaaagagtttaccccatagtcctttttactgccttttgcagaacaaacgtttaataatgtcgctattgttcattggttatcaagaaataactcattgtaactcagaagtgcttagcaaagaatctatctcatatgtactttctttatttcaagaactttaaggaggcaggttttctacgtgtgttcaccaaagcgcca

SEQ ID NO: 84286 - DNA, 1005 bp, Homo sapiens
acttgctatcagctgaagcctggcctccaagaagagctgctccatttctatctggagaagggatgagggcattgaagagtcgtggaaggcagctgtgacaggctactttaaaggcgacgcaaacatttgagacgccatgtcctgcaggcctcatttcctccattctgtcttgctttctttcccagccctgaaacccaggtctttggtctttttcttctgttgcattcccttctcactcggtttccttacgaccagctcagcagcaataacaggaatggagagggaattgtccacattcacagtacaatgctctggttttatcaggtctagagccagaggcactggaatgttaatggggccctcatttcccaagcagctgtcctctggatagcagatggcagttgtgacaggagagtgacagcaacctatgtgtagcctggccaaggtatgatgcagatttcagccagtccccagaagccaaaaacacatttgacaattggaaacatcctcataccctaggacaatatctgctgcggtgtctaagggctgactcatggcccaagccatggccttcttgaacccttggtaaagaaacagagaaatatatttctctccatctccctctccctctactctcctttctttctctctttcgctccctttctttctctctcttacacacctgttcacataaaaaacaaaaatgtaagcaccagcttgtgattaaaacaggcttcacaagcaccctgtgaggagtactgacacatttgcctctgtcctttccttcaacacctctgtttcttttctccttcccacttgtaacttaactgagagagacctgataggacacttggttcaaatctttcaatttacccaggagaaagctgtgacccagaaaggttaagagatttgtccaataccacatctattgaacttcagtcggctagaaagtttttggataaaaaggattatgtttcctcaggggaagagtaaactcttagaatc

SEQ ID NO: 84287 - DNA, 344 bp, Homo sapiens
caaatttccagcttagtgctataaccgttcagatacatcacaaatttaagtctagtggggtgctacaaattatgcatcatctcattaatgataatgtttactaatctcaagatctttgaaataaaaataatagctacctttttcagatacggtgctagtaggcactttatatatattatcttgaatcctcacaatagctcagcgaaatatccactatactcctcatttatagactaggaaaataagatttagaaagattaagtgacttgcccaatcacttagccagaaagtattgaaaccagctttcaaatccaagtttatcaaagccagtgttctgattaacc

SEQ ID NO: 84288 - DNA, 1011 bp, Homo sapiens
  misc_feature (876)..(876): n is a, c, g, or t
  misc_feature (880)..(880): n is a, c, g, or t
atcagctcctctccgggtctgcaggtgcacgaccctcaatctagaacatcagctcctctccaggtctgcagctgcacgaccctcaatctagaacatcagctcctctccgggtctgcagctgcatgaccctcaaactagaacatcagctcctccccgggtcttcagctgcatgaccctcaaactagaacatcagctcctccccgggtctgcaggtgcacgaccctcaatctagaacatcagctcctccccaggtctgcagctgcacgaccctcaatctagaacatcagctcctccccgggtctgcagctgcacgaccctcaatctagaacatcagctcctccccgggtctgcagctgcacgaccctcaatctagaacatcagctcctctccaggtctgcagctgcatgacactcaaactagaacatcagctcctccccgggtctgcagctgcatgacactcaaactagaacatcagctcctccccgggtctgcagctgcaggaccctcaaggtagaacatcagctcttccccgagctaaaacacctctcccacctggatctccagctccacgagtctcacagaacagccacactggctccttcgttgtcttcagctccacaacctaagacatcagtgggagcaccggctcctccctggacctccagctcaacgactctcatagacttaaaaggcagcacctgctcctccccaaggctccatctccaccaccctcagatttgaacagcggtagcaccacctcctctccaggtcttcagccccacgtccctccctgaacaatcccttctcatgaaattcagcagtcaagaaatctgcagcggaagtaaatgaataaatgttttgttttcaaattgaaanaaanaaaaaaaatatattaccctcgggggggggcccggccccaattccccttatggggaggtttttacgccccctccctggccggtttttaaaacgtctggatggaaaaaccctggcgccacccaaattaattgc

SEQ ID NO: 84289 - DNA, 347 bp, Homo sapiens
aatcattggctcacatggagccttttaggccagtggcctctgccgtgcacagcccaacactatttcttattcatctctcttcaaaattgtccactgaaggcaattccaaaaaaaaaaaaaaaaaaaaagccattccaaaattcttccaagcagtggcagcatcattagaataacagtatgatccctaaatttaacgtagaagttctggtatgtctactgaaaaccaatattattccattaaaatcacacttcattcagggggttaggactgtcttttccttcatattttcagggtgtttccaaacaagaggatcattttgaagccagattgctaatgtacctaaaac

SEQ ID NO: 84290 - DNA, 430 bp, Homo sapiens
gatctcagctccctgcaacctctgcctcctgggctcaagcaatcctcccacctcagctgggactacaggtatgcgccaccacgtccagctcatttttgtatttttttgtagagacgggtttgccatgtcatccaggctgatctcaaactcctgcactcaaaagatccgcctgcctcataagccaccgcactgggcctctgctgattttattctaacttaattttttttcaccttaaatggcggagctaacaacggattcaatttagctattcactcgaagtaataatactctgaaaagcacttaaaaaatcataaaaccaattcaaaatcataatgaataagattgaagaaatctttttttttaaagttttttgctacaaaattctgaatcaacatttgctacagtcaaaacaaagcagtatttttcctt

SEQ ID NO: 84291 - DNA, 509 bp, Homo sapiens
ggtgtgggtacaagggaattcaccatgccattaaatataatttaaatgaaggacagtctaaatgcccatcaaaaaggggctgataataaagatgactctcttcctgaatggaacaccaatgcagctattaaatggatgcttactaagatgagagctgtccagtcataaactatagtgaaaaggcatgtcacagtactatttagttttttattttataaatacttatgttgcagctgggcgtggtggctcactcctgtaactccaacactttgggagaccaaggcaaaaggattgcttgaggaaaggagtttgagaccagcctgggcaatatagtgagatcccatctctataaaaaaaatttaaaaatcagctgggcatggtggcacgcacctatagtcccagctactcgggaggctgaggcaggagggttgattgagcccaaaagtttgaggctgtagtgaactttgattgccccactgccctccagcctgggtgacagagtgagaccc

SEQ ID NO: 84292 - DNA, 392 bp, Homo sapiens
ctcactggccaaagtgacacttggaggctttcatgaaggagacagtcttatcagattctgattatccaaaccaacagttttaggtatgtctgctgtacaagaagagggatgctgcttactaatacaaaattgatttgttcactatcaacagaactagcaatacaaacagaaaacagtgtgcacatggctatactcacatgtacgcacatgttccaggaagaggaaaggtacatatgtgtgaagatgagtaatcttcacacatataaggccacgcaccattttctgagccaccctctcattcctcatccactgcctgactttttgccttcgttgttcttggaaacagagggatttctcttgtcttacttcagggtccttccgtctccttctgg

SEQ ID NO: 84293 - DNA, 519 bp, Homo sapiens
taaagagtagcttgttaatgccattacataggcccccacgtcctatagtgctgtggtgaaaacaacaaggtcctaataatgggccataccaatgaactaatttctactatttaaaaggacacgggaaactgctttcagtggcctgccttcttagttctggtatattctgctctatactcaagagttattctgtttcctgtgccttcagaggaccacattcccagctttatgcccagagaagtctatgaaactaccccccaccggcatcctacagagttgggatttttttcagcctcacaaagccctctgttgttcctctttaacagtcagctaactgaagttagggagaagtggtggggagcacttctgccctctccctctcctttagattttaagaggcttccagcagcttgaccttaccttttgtgtaaaatatatttagtcactcattacaagttgcaatccctttttggtccttgggttccagatggggaattgaaaagagtttttagatgtcag

SEQ ID NO: 84294 - DNA, 1409 bp, Homo sapiens
  misc_feature (1)..(1): n is a, c, g, or t
  misc_feature (3)..(3): n is a, c, g, or t
  misc_feature (72)..(72): n is a, c, g, or t
ncnggtaaatccacgggaaccttctcagtgcagtggtaatacagagtataaagtagccctccttactcttangaggaaattttgcctctcaagctctgcccttcccagcccagcccagcctacccaacctcatctcttccctgtagaccacatcccaccatgttcccctgagcctccaaggaaggggctcagggggccccatggcctcccgctccctgtggccccacagcccccgtgggccaggggaagcgccccagaagccgaagtgcccaccatgggcaaccacacgtgggagggctgccacgtggactcgcgcgtggaccacctctttccgccatccctctacatctttgtcatcggcgtggggctgcccaccaactgcctggctctgtgggcggcctaccgccaggtgcaacagcgcaacgagctgggcgtctacctgctgaacctcagcatcgccgacctgctgtacatctgctcactgccgctgtgggtggactacttcctgcaccacgacaactggatccacggccccgggtcctgcaagctctttgggttcatcttctacaccaatatctacatcagcatcgccttcctgtgctgcatctcggtggaccgctacctggctgtggcccacccactccgcttcgcccgcctgcgccgcgtcaagaccgccgtggccgtgagctccgtggtctgggccacggagctgggcgccaactcggcgcccctgttccatgacgagctcttccgagaccgctacaaccacaccttctgctttgagaagttccccatggaaggctgggtggcctggatgaacctctatcgggtgttcgtgggcttcctcttcccgtgggcgctcatgctgctgtcgtaccggggcatcctgcgggccgtgcggggcagcgtgtccaccgagcgccaggagaaggccaagatcaagcggctggccctcagcctcatcgccatcgtgctggtctgctttgcgccctatcacgtgctcttgctgtcccgcagcgccatctacctgggccgcccctgggactgcggcttcgaggagcgcgtcttttctgcataccacagctcactggctttcaccagcctcaactgtgtggcggaccccatcctctactgcctggtcaacgagggcgcccgcagcgatgtggccaaggccctgcacaacctgctccgctttctggccagcgacaagccccaggagatggccaatgcctcgctcaccctggagaccccactcacctccaagaggaacagcacagccaaagtcatgactggcagctgggccgccactccgccctcccagggggaccaggtgcagctgaagatgctgccgccagcacaatgaaccccgagtggcacagaatccccagttttcccctctcccgaattcc

SEQ ID NO: 84295 - DNA, 308 bp, Homo sapiens
aggagaatcgcttgaacccaggaggcggaagttgcggtgagccatgagcacaccactgcactccagcctgggcaacaagaaggaaattcatctaaaaaaaaaaaattcaagttacctaatttaggtaaatctttggcaaacaaaattagcttaatattgtgggcttaataaaaatagctatgttttatgagttattaccattaagtataacagaagtatacacttctttctacttggtatgttcttcctaaatgtgtacaggtttactagtcgaataagccaatattgtatcaactagattgcggtgt

SEQ ID NO: 84296 - DNA, 319 bp, Homo sapiens
tagaacacttactttactttcagactctttgcaggggtttgccctacaggatcatggaatttgtgctctgggaggtgggtgccataattattcccattcacagatgaggaaaataaggcttacagtaactaagatcacaaactaagaagcagcaaagttgggattccactccaggtctatgacaggcaggatgaggcaggaagaataagtatgatttttgtcctcattctacagatggggagactgggcatcagagaggttaggtgacctgtgcaaagccacacagcaaaagacagaacctggtcttggagccagggat

SEQ ID NO: 84297 - DNA, 361 bp, Homo sapiens
agggaagatctgaaatatatttaagatcttttgtaaagactctttacaaaaaacttgccaatgtgaataaattcttgaattttctttggaataggatgcagatctgccatgtttcttaaggcattttgtttatctctacatgtatgcaaggtttatttcccccttacctaagcttaggcaaacactaattttcagccccaggcaagagttttctttttatagacatgagagtatccaattgtgtgaaccctggaatgctaaattgaaaccctattcctgccagtaatcaatttgatgatgcgaacatttcataatataaaggctccacctctttcattaaccaatcactcaggctgctttg

SEQ ID NO: 84298 - DNA, 351 bp, Homo sapiens
ggccccttcagaggtctgattgcttacgttatggacttacaattctaaatttgttcctgaaaactttccttagtgtgcatagtatatgttaacgacaatgggtgctaggaatatggggattttgctctgtgggggaaccagagattactttgaacagaggcaagaagcattttagtaaactggaaatgtttatttccatgctgtcttaaaaatgtaaagcatattcaagcaacatggtttggtgatttgttttgcaaatgaggcaattcatttaactctagagcttccctctccccactccccatcagatgatagagatactattcacttatggtgaacttggcaatattt

SEQ ID NO: 84299 - DNA, 643 bp, Homo sapiens
gccaccttaagagctgtaacactcaccgggaaggtctgtagcttcactcctgagccagcgagaccacgaacccaccagaagggagaaactccgaacacattcgaacatcagaaggaccaaactccagacgcgccaccttaagagctgtaacactcactgcgagggtccgcggcttcattcttgaagtcagtgagaccaagaacccaccaattccggacacagtggctgggattacaggcacgtgccaccatgcctggctagtttttgtattttttgtagagacgggattttgccatgttgcccaggctggtctcgaactcctggagtcaagtgatctgcctgcctcagccttccaaagtgctgggattacaggaatttattctcattttacagatgaggaaactgcagcacagaaagtctgttacttgaccaaagttacataggtgataagtgatagaatggggatttgaacgtaggcaattctgtctcagccccagcttgttctcccattctaaagatcacatctttgactcattttgtctgcctgattgcttatggtgatgcttggggccacaggtcctcactgcagacctcccaggggcaggagccctgcccctgagccctagaccaggagccttccccc

SEQ ID NO: 84300 - DNA, 698 bp, Homo sapiens
acacaaatggattgagacagggagttagaattttaatcaaataaataactggaggaaacagtggctcaaaagaaggatgtaagacagattaccttggacaggtacaaagaaataataaaagcttgccaggagtatgatcagtaaggaagggaacagaatacatcttgccatgaaaggaaagaggaataagtggaaaaatgccctctgatacctcagcaacaagagagaggaatgaaacttcacgcccttcttgactggggttagaaacatcattataggtattgccacaaagtcacaagatttttttattacattaaaaaatgtaggccaggcgtggtggctcattcctataatcccagcactttaagaggctaaggcaggaggatcacttgagctcaggtgttgagaacagccctggcaacaaagaccttgtttccacagaaaatcaaaaaattagctaggtatggtagtagtacgcagctgtggtgccggctactttggaggctgaagtgggaggatctcttgagcctgggaggtcaaggctgcagtgagctatgatggcactgctgcgctccagcttgggcaacagagcaagacagtgtatcaaaaaaaaaaaaacatataatcttgagggatagtgattgatagggtaaattatgagcattacttatatgagaatgtaaaatttaaaattgtca

SEQ ID NO: 84301 - DNA, 490 bp, Homo sapiens
gatagaatcgagctggaccggttcgcatgtttcccggttcgctcccacttgagtcccttcctaaggactgggatgcagatttcctcaaagaagctggagcagccctcctggcctataagctagaggatgacagtgcacaaaacagcatgagtctggccccctagcaggcatggagttactaagccagctctcagccacctacccagattttcacttgaaatagaaaaaaatcaacatcttgttcaagccattattatttccgacctctgccacagcagtcaaatcaatatcctaactaatacacagaatctggaagctggaagtaatcaaccttaacaatacaaatatgcagcattggcttaggggtcagcatgggcacagatactgtaggatggaagaatggcaaccctcagagatcacaataaaacatttggcaaaacccgtgatatcttagaaaacagcctgcatgccaacatggcctgtaattcta

SEQ ID NO: 84302 - DNA, 156 bp, Homo sapiens
aggccgaatcccatttgtggagtctcttgcgtgtcaagcaccttgcagtcagctcaactacacacttttgggattcgttgcagacacgagagaaggttatcagcaaaataaaggaaccagggctcagaattaccagaacaatccatgacagaggag

SEQ ID NO: 84303 - DNA, 265 bp, Homo sapiens
ttatcaggtagtgataaatgtaacaaataaaacatccagaagggtcaggagcctgtgtgtgtaggtgagtaagaaggcctcttggagaatgtgatattttagcagaaacagaatgaagtgaggaagtgaaccatgaggactgtacagaggagagtagtccagagggagaacagcaagtgtaaaggccctgaggtcagagtgtgcctagaatgctcagggaatatcaatgggacagcgaaatggtaggtcatgtaggggacttgca

SEQ ID NO: 84304 - DNA, 866 bp, Homo sapiens
atcttatttcttccctgtttaatttttataaagattgtaaaaatacattttagctcaagagttcaaggctttcagagccctttgtgcagattgctgctccagtcccgggctattgtgtattgtgataaattgtgtgctcttccagggactgttactcatttttctatccagcacagtgcttggcacatagtgggaacacagaaaacgttagttgactgacatttgattctaaggagcagaatcaaagtgtagatttcggattcattttagtcgttgaattgtgcagttttagtttaacaggacaataagaaaatgactagttcatgtgcaaaatgcgcgttttgaaaaaatacttaaatggagcaactcatggggtcttggaaaattctgtcagtttgctggatctctccgttctactatcatgtttgagcttctgttcctctcacttccagagttctgaaagagcagtctatgctggctgcttccctttcttcacgtcttcactacacagtcattctttaaacttttgcagccagattgttccaaggttgccaattacctagtgggtaaatttcccacattggccgggcgtggtggctcacgcctgtaataccagcacttttgggaggccgagtcaggtggatcacgaggtcaggagatcaagaccattctggccaatatggtgaaaccccgtctctactaaaaatacaaaaaaattagccgggtgtggcggcgcatgcctgtagtcccagttactcgggagcctgacgcaggagaattgcttgaaccaaggaggcggaggctgcagtgacctgagatcgcgccactgcactccagcctgggcaacagagcgaggctccgtctca

SEQ ID NO: 84305 - DNA, 503 bp, Homo sapiens
actcatggggtcttggaaaattctgtcagtttgctggatctctccgttctactatcatgtttgagcttctgttcctctcacttccagagttctgaaagagcagtctatgctggctgcttccctttcttcacgtcttcactacacagtcattctttaaacttttgcagccagattctcccaaagtgctgggattacaggcgtgagccaccgcgcccggccttaaaaatgttttcaagtcggagcaataccacttgttgaaatggcagtaataatattagctaacatttattgtatgcttactctatgccagccttttgacatcttttcccctaattcttagcccaagcctgtggggtaggtatcgttactatactatgaatgagaaaagggatctccaggacctgacgcaggagaattgcttgaaccaaggaggcggaggctgcagtgacctgagatcgcgccactgcactccagcctgggcaacagagcgaggctccgtctca

SEQ ID NO: 84306 - DNA, 373 bp, Homo sapiens
tctacctagaatgtcctctctcttctctgcacgtccttagtaacccctgtggcccacttcttacttaggtctctcctaacatgtatctatgacacattgatccctaacagctatgattcttcttatactttttcagtaatttaaattttatcattctactgcttgttcaatacatctctctatgtaaatcttgactccataatgaggtttttaacttcgaaggggttggaagttatctgctgccttggtacccccccgccattacacaagagtacattttaagcacattacacctgagtgattgttgtaaaacacagatgcaatctttccaccatcctctaagaattcttctgtggcttccattggtgaattc

SEQ ID NO: 84307 - DNA, 717 bp, Homo sapiens
  misc_feature (591)..(591): n is a, c, g, or t
  misc_feature (629)..(629): n is a, c, g, or t
ctacgtgatcctgtgcattttcaccacatagatctgctagcttacaaatgatgcacacagtcaaggtaggaattataggcctactcagagggtacccagacacagaaagttttagggtaaatagtaaactacaaataccctcttggttaagttaattcatcaagttaataaaggtcatattatctatcttctgctggtgacaacttgttgtctcagtatagtctgtctcaagaaagaactggttcagattgcggtgttgcaaacaccgcaatctacctataacagagtgttacagggattccgtaatctttgctctccagcatctgttggccggggtagatggggggtttgttgtccttggaaacctggaaggaactattagtcatgtcttaatcctgagccataaatttacactcatttgagagataagcaaatttggcagaaagactgagtcaaaaatctttgtcttgatctctgagacaggattagtggacaaactaaatcataaattatttattattttggtcacagaagcgtgagccaccgcgcccagcctatagctctttactttttaacatgccaccatatctngtctgacatgagattattcatttagaaacattttattnggtcttccaaatacattagaatgtcagccacaaaagatagcttggggccttataattgaaccatttacttataagattgcggtgttag

SEQ ID NO: 84308 - DNA, 360 bp, Homo sapiens
cctgttacttcctcctccggttgtgccttgcataacctgtgtgctgccagagcctagggtgttccaagagagacacatgctccggctgccaaccccctttctgctcaggagaccgcaactcagtgatgatctccagtggaaaaagacagacttgaaataaattcttgttggactccagccatgtaccatgcacagaaacctatccatcatgtagatgctaacctgtcaggtaggtgctatagttacccattttacagaagagaaaacagaggttcgccagctggcttcaaatctagctctgtctgactctgaagtcttcattctctccagggatgtcctgctgcctccacattcctttaa

SEQ ID NO: 84309 - DNA, 858 bp, Homo sapiens
tttcctttcagaagcactgctgacagtttggtggttgccattgggacagtgagccttttgttctttctgaggttgggctggtttctcctcttggccctgccctacagaccgtaaaggaaatcagcaagaagtccccagcaaacatccacagatggccctggacatcagccacattctgagaaacatgtcacgttctgggagggctaaggcatcaagtaaggcctatggggctggagaatccgagggcaggtggggcaacccagagccatgggggctacccatgggaattgggaggtcccaagtcagatgcaggggttccacaggagaagtcccagagccaccaagtgctctcctgtcccagggagcagtcaacaccatggactgaacacttactgggcttcaagctctgggccaggctggggcatgtggggccatgagggagctcagagtgggagacagagagacaagtgtgctcagagggcacccatttctgggtgtaatgtggtcctgagattttggctgagaagggtttccagggtttcatatgtgttatggagctgcttcctctccccagcctcaccttgcaggaatcccagtgaatatattgccaccctatttgagctcagtgccctcatggtgtaatggcaccagcagatctgcctgtgcatggacttcctgtactacccattcctgaggggtgatgcttctgcagggcctatgacctggtgcacaactttagacaccatcatcctggagcagcactgcaccctcactagccagggtgttcatgacttcctcaaggccaaggccacgttcaagacttgggacttcagtgatgcacttgtgctgggcaaggtg

SEQ ID NO: 84310 - DNA, 308 bp, Homo sapiens
cctgtgctttgggaggaacagaggattgagaaatggtggcggcatggaggcagcagctggaggctgctgctttagttcaacatgccaaagtgccatattttggagttctgttttctgagacccaacatgttctatttttcccatttacatataaacacactgagacaagccgggcacagtggctcacgcctgtaatcccagcactttgggaggccgaggcgggtggatcactaggtcaagagttcaagaccagcctggccaagagaccaccctagtcaacatggtgaaaccccgtctctactaaaaac

SEQ ID NO: 84311 - DNA, 637 bp, Homo sapiens
gccctaaggctagagagaggatggtcctctggatgggagaaaggccagcctgcctgggggaagatagcctctcattgcacaaacatctgttccttgaggatcccgtggcacttcacaaccctcttcctctcaactcttatcttttgcctaaggggggtaatttgttttttcctttctctttatctgattgcaaatccaaaacattatcttaattacagaagatcctagtaagtcctcccagcattcgaagaatgtcttaagtcttgaagtgacattaaatataattagtaaaacagaaacaaaaccatcaaccttcacaaccctaagaaatgccttttggtaacaccacaaaattatttaactagtgtctccccctccaaataaatctgtctttgttttgttcagtttttccattatagatatatcaagacatcatttattaactaaacttccacagaccagcctggaatgcaagttcctatttctgttatgttttctattgtgaaactgggtttcaagctacaaacaactgattctcaaagttttggcaaagaatccatttttactgttgggactttgtttttgaattggaaagggtggtgtgtccaggtacagggagggatgatgtaagtggtcc

SEQ ID NO: 84312 - DNA, 1191 bp, Homo sapiens
  misc_feature (1)..(1): n is a, c, g, or t
nctaagcgcgactgactctcttaactaccaccgctacagatatcatggaaatcaggacagtggcagttcggattgtggcaatcaaaggggtggaaagtgaattctatcttgcaatgaacgaggaaggaaaactctatgcaaagaaagaatgcaatgaagattgtaacttcaaagaactaattctggaaaaccattacaacacatatgcagcagctaaatggacacacaatggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagtagggagatttctttaagtggactgttttctttcttctcaaaattttctttccttttattttctagtaatcaagaaaggctggaaaactactgaaaaactgatcaagctggacttgcgcatttatgtttgttttaaggcactgcattaaagagacatttgaaaagtatacacaaaaatcagatttagtaactaaaggttgtacaaaattgtaaaactggttgtacaatcatgatgttagtaatagtaatttttttcttaaattaatttacccttaagagtatgttagatttgattatctgataatgattatttaaatattcctatctgcttataaaatggctgctataataataataatgcagatgatgttatataaggtatatcagacctacaggctgctggcaggatttgtcagataatcaagccacactaactatggaaaatgagcagcattttaaatgctttctagtgaaaaattataatctacttaaactctaatcagaaaaaaagaatattctcaaaaaaatctattatgaaagtcaataaaatagataatttaacaaaagtacaggattagaacatgcttatacctattaacaagaacaaaatttctaatgctgctcaagtggaaagggtattgctaaaaggatgtttccaaaaatcttgtatataagatagcaacagtgattgatgataatactgtacttcatcttacttgccacaaaataacattttataatttctcaaagtaaaattgagaaatctttaagtttttttcaagtaacataatctatctttgtataattcgtatttgggaatat

SEQ ID NO: 84313 - DNA, 535 bp, Homo sapiens
ttccagtggtgtctgtgttgagccctgagaatgattgagggacctgttttgtggtcattgaggaggaagaccagtaaggcataatgagtttgagagcattttccctgcaaagaagtgcctctttcttgagtcagcctcgaagactaggattccctggagtttggtgacagaacccccaggattcagaacactcaccagccactctcaacacaaggcattctggaggacaggtgatgatggtggattttataaggcatagaatgaggaatctcttccaagcccactccaactctggaccacatttaagagaaaggaaagtgcatgtgaattggagggggtgggggtggggggtcacgtggaccatctgatccaggctgaaaagctctcagggctgaggaaaggtagacagggttccaaccctgaggagcagggacttaaatttaaacctgctgggcacagtggctcatgcctgtaatctcagcactttagaggccaaggcaggcagacctcttgaggccaggagtttgagaccagc

SEQ ID NO: 84314 - DNA, 625 bp, Homo sapiens
aagtttccaggcacttgtcaactggaactgtgggtgtttgatctttgagagaaggcagatacacaggaggtaagcactgtgtatttgcttggctctgtgttggttttcttgctttcttcaagggacagcactgtggttttgtgaagctgaagaggcagaaactgtagttcgagattgctaaggtgacttgaatttgtggagcaaggtgccagtgaaaaagggctggatggaatgaggggcaggagactgtacggagatctcctgtggatcctgggtttacagagagaaaagcacatgctcaggatgagactcttcaaggcccagcatagaatggctgctccaggattgagagctgaatggagatggctgtggctgtgtagggctaggatatgataaacttccgggcaagtcagaaagcaggggcctcactaagcaaagagggcattcaatgaagacctcagaaaggccacaggttcaagttaatgaccacaccctaagtgagcacgtcctcatcccccagattaaagacagaaccaaaacagtcaagacaagacctacacgcacacacacagacacacacacacagacacacacacacacacacacagcatgacaagatcaagag

SEQ ID NO: 84315 - DNA, 384 bp, Homo sapiens
ttggataaaagtgatgagaccagacatcctttctttgcttctgatcttagagggaaagttatcagtcttttactcttaaatatggatgttagcccagggttttttgtagatgccctttattaagatgtaggaagatttgagcacttttatcaagaatgaatgttggatttcattaaggcttttctacatgtgtggaaatgatcactttgctttttttttcttttagtttcatattttatatatagattgaattgtgtccctccaaaaaagatatattgaagttataatccccagtccctttaaatgtcacttgtttggaaataaggtctttatagaggtaattgagatattaggaattaggatgggcagtaatccaatatgact

SEQ ID NO: 84316 - DNA, 219 bp, Homo sapiens
aggcttttgccaactatcttgtaagcataaccacatttttaatgtttcttaggggaaaatgtatccaaacaatcagcttccaaagcaagcttgggaacccagttctctaaggtgtggtaacttggacatgcactttttaacgacgtgcccataatatctttgcagaaattgaggattaagtaacacttaaaaatagagaatatggacttagaaaaagag

SEQ ID NO: 84317 - DNA, 306 bp, Homo sapiens
aagaatttcagctataggcagagacacttgccatcttagatctcacaactctaagccaagaaacgcgcgtgcccctctgacctgctacgcataccgggttatcatttcccgggttctagggttaggggctatccagcgagatgaaccaccagccctgacctggcctcttgggcgagagaaacacaccgcaaccacctcggagtaggcagcatgcctgtgtgctgcagcttccggtaacagaatcctagcttgctctgcttgtctgggagagtgacacgattcatttcattttgcatttaattctca

SEQ ID NO: 84318 - DNA, 396 bp, Homo sapiens
gtgaaatctctagagctttccacataaaattatattatctgtaggctagagtaattttacctctacatttccaatttggatagtttgtttctttttaattcttaatttgactagaacttccaacactatgtggaatagaaatagcaaaagcagacacctttgccttgttcctgagcttagagcagaagctttttgtctttcaccctggagtacattgtttgatgtggttttttaatgtgtggatttcacaatggtagtattttagttttaaaattcctacttttttgagtgttttcaccctgaaaagattttgaatttcataaaatacttttctctgcatccatgaggtgatcaatgtttcttttattttgttaatgtgtacacattgatcaattt

SEQ ID NO: 84319 - DNA, 513 bp, Homo sapiens
ggatgagcacaggagggaagcatggggctgaaggcaggctttattatgtgaaacagaaactactgcgataggttcatatagtgatgagactgattcagtattgagggggaaactgataatgcaagggagagagaaggaggggaatttagaattgcttgcaggggaataaatacatatttaatctctatactgtccgaggcagttctccataataacaaggccaaaatgctaaattattctgtggtaataagcttaagtttcactttaaacataaagaaacttccttttgaactattgaatcacaacatatatttcagaatagaaaatcaactctattatatgtctctccttttaaaaaaaatttagaagatctagcaactgaaaatatttttccttttttatttatgtcaggagtactgaggaagcgtatgatcatagctgctgggatccatgacagcatttgtaggtgagtaatgaatggctttaaatgagagacaaacccgagacaatatg

SEQ ID NO: 84320 - DNA, 270 bp, Homo sapiens
acataaacttgccttttataattccaggcactagaggttgacttctaaccctgacaccttttatttctgttcttttcctttccagtcctgttgtatataagaagtatcctatgtccactagctgactctgttattaatagtgaggacctgttcagcatggttttcctaaaaggaaactatccagctttcatttgcatttatatgacatggtaggtctaatgcttctttcaaatcaaaatgactgttttttttctgtgtagggtgtgtgtg

SEQ ID NO: 84321 - DNA, 864 bp, Homo sapiens
  misc_feature (710)..(710): n is a, c, g, or t
gctttcatatagattatcatgtctttactgatttaaggatctctgttttaggattagaaaataatttcatttgtccctgtaataatgtacattattagaaaataatttcatttgtcccttagaaaggagggcaagtgcaacatttgcaatgttttcttttaaacatttttctgatagaagattatataatcagtttggttttagatcaagaaaatacgattaagacctaattagatatttttatagacttgattttaaatcagtaattactgcttttaaaacgctttgaccaaaaaagatgatccttgtaattaaatattaccaagtaaaactacttggtaaaatatggttttatattattctatttacatacatttattttggtcccaactcatgattgtaaagcctgtgaaccacaaagtgttctggatcatcaaacgatagcaaataaaaattaaaaaaaaaaaaaaaaaagaaaaaaaaaaaaaactctgtgttgcggcgcgcgccccgcggcccccgcgaaaaagcttttctcatagaacccactccgcggtggggcgcgcgcgcgcgggcccccgatgggttaggggacaccgtgggtgccataacgcgggttccccagagaggagaatccgcgggcgcacaatgaacaagagcggcgcggggatattctctccacccaatattagaaaaaagcgccccgcggngggaaaaacccgagagccgttttcgtgacaacacaacttcccaaggagggggagttcttcgaggggggcgtcctattaagggggggacttctaattcaaacagggggggttccacaaggggaaaatctccgtattatccagatttaaggcccgg

SEQ ID NO: 84322 - DNA, 213 bp, Homo sapiens
gcactttggggccatggggtggaggtgggctgggagaagttggcaggagtggggaaggagagtgcacgaattaaatttctttagctttgcagagaaacctcagcagtttctctgtgctgcttgcaaaacatcctcagactttcacatgtataattagctgtggaaaaagctgggagttacctcgtaccgctgttgtttgagtgtgtgtgagcg

SEQ ID NO: 84323 - DNA, 722 bp, Homo sapiens
caaataagttataggacaactttacttttaattaacttttatttctcatgagttgatttttttgtgacgttcctcttgattttcccagattctcatgtcaccagggtagataggctggcagtggccaatgttgttctaagagaaatcctaaagactacccaatttttttttttcttgaatccgcaggatcctgttttgtgaaaattcctcttacgcccacctataggatagacagtggaggccccccctgggagaaagtgtacacagaaagtgctatctaattacagaagtagcagaatttcctttgtgctcagaggggaagtgctacaaaagtgtaattactttacccagcatgtgtgatttacgggacttaaaatgtgtgagtttccaaagagtcatctgtttttaaatacagtatccctcccagccaggcaggatgtgtttggggaggtgggagtgaggacatgtacttccgtcctgtgcctgctgcaggatgcctggtgacaggggactgaaaccactggtacttgctgcccctcagggtcttgcttatctgagtagaaggaagaaaatcagcaaagggctggaatctagtcagctactcccagaccagatcatccactgctctcctcttaccttcccaagccaaattctttttctaggacctccaagacttttcccagtaataagcaaaagaattgttagagtgaaccctgagaccg

SEQ ID NO: 84324 - DNA, 298 bp, Homo sapiens
tataaactggcttaatcatcatttcaaacactagtttgaagaattttgtctatatgtgatatgtaaacatttctgaataactatttcatgtcactttgagagggagcaatgatttcagataaaatatccctctaaatcttgccttttgtgcctaatataatatttattgtatttgacatggataatgcttaggaaataattctagggcttggatttgaatcacactcagtaagtttggtatgtagaagtgaaacccttagctggcaagcaaggtcagttagccatctgatatattgtt

SEQ ID NO: 84325 - DNA, 346 bp, Homo sapiens
  misc_feature (306)..(306): n is a, c, g, or t
  misc_feature (337)..(337): n is a, c, g, or t
  misc_feature (343)..(344): n is a, c, g, or t
ctaaacctttttcaatcacgtatcacatacccttattcaaatataagtaatttaaatgtcaaacatttttcaaagtcccaataaatttgtattgtcttctgtttaacagtttgattactaccttccatggttctggaaaattgaatttaaatctatgaaggttaaggtaaaaaaatgagctttacatcattcttagtttttgtattatagaagatataaaaatctttggaaagactttaattcagtgccttttgtgagttgggaaattatgtcaaaactcagtggactgaatattaataaaacttncttagcatcttactagactctgtagaaaaanaaaaanntt

SEQ ID NO: 84326 - DNA, 550 bp, Homo sapiens
aagatgacaagagtgatagtgaacctgatgtgttggttgtattgtgaaagaaaaaagggaatcatgggaaatagtatgggtcagctttgagtaactttttccatgggcacaatacggtacatactaattatgaatccaacaaactctatgaggactgtattgtgcaggtgtggagatgggccgtgtgtgtgtgggtgaggagagcagtaaaaaagaattaaagtcaatagataatgttaaaaactgaaaaaaaacaatcacatgtcaataaaagccatgttacttggagatacagaaataaataccaaaggaaaaaccagggtgttatgtatggcatagggctgatgtgcttttgtaataagtcagacagaactacgtgattctatgtgcatctatggcttcagggaaagtaaaaaattttatattttatagaaactcaaaagagtgctcattgcactagtatttaaaaccatccacttaaaaaccaggatatttaatcttgtgcaagcaacacaggagtcaagagggccttacgggtaggagcaaaaca

SEQ ID NO: 84327 - DNA, 319 bp, Homo sapiens
ccactaaaaaaaaaaaactaccaaaatattgtcaaaagtatgtaccacaaaaatcaggactcccaatgaaaacgattttaagccatgcataatttcatcccagatgattcagaaaacaaaactgcagacatttgttatattttcttttcctgttttttaaatgataggccctttccattagccacagttactaagtccaccttttctaactatacacagccatccatactttggcaaatatataaatttaggccacaaaaatttgtttacaagatttaaaatatcagacaccctaaaatttaactgggagtgattttat

SEQ ID NO: 84328 - DNA, 474 bp, Homo sapiens
agagaaggtggagatggcagatccagtgcagaagccaatagcaacgccctagaaccgggaacaccgtggaggggatcagatgtgccgctgcctcgggggaacaagtcccagagggggtgtctctgggagacctccctctgccaggtctggagcagaggcagggccaggtcttgacatgtatctctggtaaagcaaggactggagcctcctcaccccgatgaactgtggaggcgggctctgaacggctagaaagactgaggttcccacccactgcccagaaggtctgtgatgtggagaaaaagatacatcactgtgtttccatcacaacagcagagcaaagctacagtccttccaccaaaatactgctgatgaccgaatcttcatccaaaaggccttttactttcgtttgatgtccaactccataaatactcactgaatatggacaacatgcagggtaccagacctatgtgctta

SEQ ID NO: 84329 - DNA, 390 bp, Homo sapiens
gatacaaataaggttatgaaggagactgcagaagagtcatatcatcatgaacttaggtgactagaaaaagagaaacaggcaaaccctaaagaattcatatgcacattgtgcatatatttgtacacacatatcacatttggacaccaaataagatacagaattccaagtatttcatttattgtggattaagctgttcagtaaacaccataagttattggtaatttatactttaagataataccaataagaggtgcatgattatttttgaaactgacggacttcaactctataataaacatttataaaatatttattgtcaatgatgatgcatgactatctttctagtggggcacagccaggttggctgatagactagattgcggtgtttgg

SEQ ID NO: 84330 - DNA, 377 bp, Homo sapiens
tcccaggttcaagcaattctcttgcctcagcctcctgagtagctgggactacaggcacacaccatcatgcccagctaatttttgtatttgtagtagagacaagatttcaccatgttggccaggctggtctcaaactcctggcctcaggtgatctacccgcctcggcctcctgaagtgttgggattacagaagtgttgggattacaggcataagccactgctcccagtcgaatgccattgttctgaggagaaacatgctgaagtgtttataagaatcacaatgtctgcaacttaaatggcttggcaaaatatgtgtgtgtgaaagaaaaagtaaatatggcaaatgtcaacatcaggtaaataaaaaaaatttaagat

SEQ ID NO: 84331 - DNA, 654 bp, Homo sapiens
cccaggacttgtgggctgtgcagagtcgtgcgtcctttgacagcggcctccggccgggaggcaccagctcttcgaacaatgtttaaaagtctcttctgttcatcctaccggggtgccgtctcctgccggtcttttcactctcaccaggcccctcgcccgggcaccccccggccaatggaccactagctgcacccggttcatccaccgcgcggggtaccacccactcggacccgagccggcttcaagaggggcaagcaggccaaggatccagcagaggcctcgtggctctgagtctcagtggcaccatccctgcgtcacgtcatgctagcccgagcaccggtctcacgagcccggcccctgccctgcgaccaggccactgccctgttgcgcccggcccacgatggatggccaagtggggatggcagccaggaggcagggactccggtgtcagccaaaccagccagaccacgacagcagatggtacactgtgggcctggacctggagggggcagaagagagcctctgccacacccggaccccctgggctcctgaacagtccaccggcctgcagactcggatgacacttaacgccgccgggccctcagctgccctcctggaggggctcctgctaggggggtgggaagccatcgaccc

SEQ ID NO: 84332 - DNA, 131 bp, Homo sapiens
cgcacacaggctaggtggcctcttctgcacaagatgggccaccaacaaactcacctatgctacatacctgctccccaccgcccccacctcactcgtaaagtatggggaaaagaaagcaaaagccctttccg

SEQ ID NO: 84333 - DNA, 315 bp, Homo sapiens
cctaaccactccttcactttcagactaattctatagttctattttctccaatatggtagtcacacatgaactagtaaacacttgaaatgtggctgatccaaactgagatgtgttgtaagtatacattacactggatttcaaagacttagcaagaaaaaaagaaagatatctcgttactagtttttgtattgattacatgttgaaatgatagtttggatatactaaattagattattaaagttaatttcagctgttccttcttccttaaaaaaatatggctagtaaataactttaaaattatgtgctcactttata

SEQ ID NO: 84334 - DNA, 385 bp, Homo sapiens
gccacagtcttatgtgcctgcaaagaaagctgctgagtttacactttttaaaaattctgtatcacttctccatcccactccccagaagataccactgttggtatttttagtatgtgtccttccagacttacttccatgcatatatggcttatatacatgtactcacaattcacacgcaagcttttttcattttctgatacatcatgaaaactcatccatgttggccaggcatggtgactcatctgaggtcaggagttcaagaccagtgtggccaacatggtgaaaccccgtctctacaaaaatcagccaggtgtggtggccacacgcctgtagtcccagctactagtgaggctgaggcaggagaatcgcttgaacctgggaggcg

SEQ ID NO: 84335 - DNA, 344 bp, Homo sapiens
agcataaggacagatatatacatcagtggagaagaattgagagcccagaaatacaccctctctatatgatcaattgattttcaatgaagatgccaataccatctaatggggaaaggacaaacttttcaatagatggtgctggggaaacttgatagctgcacgtaaaacaatgaaattgtacccttacctgataccttatgcaaaaatggactcaaaatgaatcaaagacctaaatctaagagctaaagctataaaactcttagaagaaaacataggggaaaagcttcgtgatactggatttgatataatgatttcttacatattacaccagaaacacaggcaac

SEQ ID NO: 84336 - DNA, 612 bp, Homo sapiens
tgtgaggcacaggatctcagtcctagattccagggtatcgctatttcatatacagatttttaaaccagtgtttggcctgaactctcatctccagttacagataaaaccagtgcctgcaaatctccagccttgagagaggtaaagactgatttgcttcttccatgtccctctacaagccaaataacaaacaagtcttcatgggaacgaacagtgggcacatttgaagatgcagatggtgcaaagggcctatagcgtaagggttgaagtggacaagccctgatgaagccctgatgaacttgaaaatgaccaaccagacctccctgctaggaaacagcctcactcacacagaaaaaaaactgctgaaaattaaaacagaattgaacaggaaaaggttctccagaaacaaaggaaagaggaggcccacataaaagtgaggggcagtagtagaaacaggagacctcaaaggcaatctgtgtttcataacggaaaaataactctgtgaaattagaaatgctatcctgagtcactaggctttcttccaaacattcaggaaaatgaacttccaataaaactgacccatggcaaagttttcagatccaaatctcatagaag

SEQ ID NO: 84337 - DNA, 390 bp, Homo sapiens
atattctattttgagatctatttgtcttagcttggaggtggttttgttaaatgtccacgatttagagacggcataatgaaaaaatgaccaagaatttggttgggaatgggaggagcttagaagaacaagaaattggctttgattttatagtgtatggtgctctgttggtagctggacatcatcacaggctttggattgagaagacctgttctggagttctagttctgctactgcctagcgttgtgatcttgatgaagatactcttccttcctgggcttcagtttttgatctataaattgctagtgatggggctggactatttttaagtttgttctaactttagcagtcttaagaattaaggttgcatgccagaaaatagggttaaatatt

SEQ ID NO: 84338 - DNA, 555 bp, Homo sapiens
gccctggctctatgtatcatagcaaatgagaccctttgcatgttttgcatctcttaggaggcctggagtattggcaatagcaggtcaaagaggaaaggcgagctgctggcccaggatgctacagaaggggcctggtcaagaatcacgaccaaaatagctcctgttgacaggagaggctcctcttcatcaacgccccttattaacctttgcagaacaccgtgactgctctggcctggcaggcagttttagtaccatcctgatgcctgggcaagacgggatcctccctcagccctgtgcccctgagggccccactccccactccacagggtaagaggtccagggcccactgggatgtgtccacctagagtttttgcctcaccttctagaccagggtttgcaaatgactcctgggccactagtttccattcagctcataagctaagaatggtttttatatttttaaatggttgtaaaaacatcaaaggaagaatgatatgtgaaaattacatggaatttaaattttggtgtccataagtaaagttttcctggaacatt

SEQ ID NO: 84339 - DNA, 517 bp, Homo sapiens
ccatttggatttaatgattcacccattcattattcaaaagcatattgtttaatttctatgtgtttgtgaacattctaatgttcattctactaatagttcctaggttcatgcaatgtgcttaaaaatgtggtataatttctgtattattaaatgtaaaactagtcttgattcgtaacataaggcctacgcaaagatccatcttctgcagagaagaatgtagattgtgccgctgttagacgaagtattctgtatacgtcagtttgctttatttggcataaagtgtagtgtaagccagatgtagtgtaagtcagatccagatgatctgcccattgctgaaacttcagtacttaagtcccctattattattgtatggcaatctatctgtccactcagaagttattatatttgttttatatgattgagcacttctgttttgggtatatatgtatttacaattactataacctcttgctgaattaaccccttttaccattatgtaataaacttatttcccaaa

SEQ ID NO: 84340 - DNA, 1662 bp, Homo sapiens
  misc_feature (1563)..(1563): n is a, c, g, or t
  misc_feature (1630)..(1630): n is a, c, g, or t
acgcgagctgggcagggaagagagcgcccggctcagtactgcgcgcgccctgcggctgtccggggccgcgcggtggccaaagcacagcgcgggagagtctgcgatgtcagagaacggctccttcgccaactgctgcgaggcgggcgggtgggcagtgcgcccgggctggtcgggggctggcagcgcgcggccctccaggacccctcgacctccctgggtggctccagcgctgtccgcggtgctcatcgtcaccaccgccgtggacgtcgtgggcaacctcctggtgatcctctccgtgctcaggaaccgcaagctccggaacgcaggtaatttgttcttggtgagtctggcattggctgacctggtggtggccttctacccctacccgctaatcctcgtggccatcttctatgacggctgggccctgggggaggagcactgcaaggccagcgcctttgtgatgggcctgagcgtcatcggctctgtcttcaatatcactgccatcgccattaaccgctactgctacatctgccacagcatggcctaccaccgaatctaccggcgctggcacacccctctgcacatctgcctcatctggctcctcaccgtggtggccttgctgcccaacttctttgtggggtccctggagtacgacccacgcatctattcctgcaccttcatccagaccgccagcacccagtacacggcggcagtggtggtcatccacttcctcctccctatcgctgtcgtgtccttctgctacctgcgcatctgggtgctggtgcttcaggcccgcaggaaagccaagccagagagcaggctgtgcctgaagcccagcgacttgcggagctttctaaccatgtttgtggtgtttgtgatctttgccatctgctgggctccacttaactgcatcggcctcgctgtggccatcaacccccaagaaatggctccccagatccctgaggggctatttgtcactagctacttactggcttatttcaacagctgcctgaatgccattgtctatgggctcttgaaccaaaacttccgcagggaatacaagaggatcctcttggccctttggaacccacggcactgcattcaagatgcttccaagggcagccacgcggaggggctgcagagcccagctccacccatcattggtgtgcagcaccaggcagatgctctctagcctggatctgaggcacaccagcagcatgacaaactcatgaaatggtgggagagagtctgctgcaagggtgagaccaggcagcctgctgggccacactgtcctgttggcatcacagccccaaggctgggggaacttcatgctgggacaagcagcccatcaacgccatgggttcaggctgatccaggagatgctcacaggccacaggacctggaaaacactcttggtggtgtcttggggatttggtgcacacaagaccaaggaaaggacagaatgaggaaaggcctggggcagaagagcccaactccttctcatagctgaccctcatcctcctgccttggcctcctggctgctttctccccttccccccagcntggcaggatctcttcctgttagcaaggatgaaagagagaggtcagtaggactggaacttggtaactncaagggcctcaggtggggcaggtgcagagggc

SEQ ID NO: 84341 - DNA, 606 bp, Homo sapiens
tgctatctcccaagataccctggttgaaagatgtttgggaaaggtttcaagtactatctggagtaaaaggtgttactgttgggatacatgacaatgagcttctacggtcagatattcatttgagtttgaacttgggatacgtgttgagaaaaccagttctgctcaatttttaaatcctaggacactcgaataatattccattgtctggatgtgccacacagtttgtttatttattcacctattgaaagacatcttggttgcttccaagtttgggaattataagtaaaattgctgtaaacatcggtgtgcaggtctttctgtggacatatattttcaactcacttgggtttttggtgataaaccaggagctgagagaatcaaaaagaatggtaaagcccaggcccaggacatcaagcaatgtacatatttggaatgacctcatgctgtgggccctgattgtaaataaaaatgcttttgcggaaacagcaaaatttggggaagcctgtcttccacctccttgactgaaaagtctggtcagaggtgccacctggctacttcctcctcatccttctaggaccttcctctggacccctcagttctgagccc

SEQ ID NO: 84342 - DNA, 508 bp, Homo sapiens
tgctatctcccaagataccctggttgaaagatgtttgggaaaggtttcaagtactatctggagtaaaaggtgttactgttgggatacatgacaatgagcttctacggtcagatattcatttgagtttgaacttgggatacgtgttgagaaaaccagttctgctcaatttttaaatcctaggacactcgaataatattccattgtctggatgtgccacacagtttgtttatttattcacctattgaaagacatcttggttgcttccaagtttgggaattataagtaaaattgctgtaaacatcggtgtgcaggtctttctgtggacatatattttcaactcacttgggtaagtactaaggaatacaattgctcgatgcgatggtaagggtatgtgttgttttgcagtgcatcaccaaactgccttccaaagtggctgtatcattcccccaccattttaaggcacagcctggccagccatgccaggatgtagcattgacttcttagatag

SEQ ID NO: 84343 - DNA, 586 bp, Homo sapiens
acgcgagctgggcagggaagagagcgcccggctcagtactgcgcgcgccctgcggctgtccggggccgcgcggtggccaaagcacagcgcgggagagtctgcgatgtcagagaacggctccttcgccaactgctgcgaggcgggcgggtgggcagtgcgcccgggctggtcgggggctggcagcgcgcggccctccaggacccctcgacctccctgggtggctccagcgctgtccgcggtgctcatcgtcaccaccgccgtggacgtcgtgggcaacctcctggtgatcctctccgtgctcaggaaccgcaagctccggaacgcaggtttttggtgataaaccaggagctgagagaatcaaaaagaatggtaaagcccaggcccaggacatcaagcaatgtacatatttggaatgacctcatgctgtgggccctgattgtaaataaaaatgcttttgcggaaacagcaaaatttggggaagcctgtcttccacctccttgactgaaaagtctggtcagaggtgccacctggctacttcctcctcatccttctaggaccttcctctggacccctcagttctgagccc

SEQ ID NO: 84344 - DNA, 889 bp, Homo sapiens
taatgtattaatatggtgaattaaattttactgatttttgaacgttaagccaaccttgcattactgagataaaccctacttggtcatgttgtcagattcaatttactgtaattttgtttagaattttgttttctgtgttcagggtatataccggcttacagttttcttttcttgtactatctttgtcaagttttggtattggggtaaaaaaaaatgtgttgagaagtattacctcttcttcaattctctggacaaatttatgtagaatgagtgctcagtctggggctaattatttcccactactgaggcaagacctatctcagtagtctacccaatgctccatgaactgagtttttccagtctacctggtaagaaaaggcactacttatagccctatctgagcaccaggtaccgttcaatctaatcttttgggatgattctttagcctcaggtagtttccacatatgggctgattagagctctgctgaacactacagtggaagcctctgcagatctcagggatcctctgtgcagctctctcttcaccctgatattctgtctgtgaactccagccactttggtctcccctgaccctcagcttcatctcttcaactgaggaagttccctggactctacctaggttccctctcatagtaccacaacccataaatctctcaaggcagaaagctggcacaatcgaagggccaaccttactgtttcccctctcagggtccttcactacctgatgaccaatgccttaaaaaccattgtttcgctgggcgtggtggctcacgcctgtaatccgagcactttgggaggccgaggttgtagtgagccgagatcatgccattgcactccagcctgggcaacgaaagtgaaattccgtctc

SEQ ID NO: 84345 - DNA, 963 bp, Homo sapiens
tacaggcggccgccaccacgcctggctaattttttgtatttttaatagagacggggtttcaccgtgttggccaggatggtcttgatctcctgacctcgtgatccgcccacctcggcctcccaaagtgctgggattacaggcgtgagccactgtgcctggcctgagaggacaaatatttttaaaaagaaatgatagttctttatgtatagaatgtgggatgatttttttttaattgccctcgttttcagaacatgtattcagtttgatcagtgattttcagtcttggcactattgacatttagggtcggataatctccaggctatcctatgcattgtaggatgttctgtagcactcctggccactacccactagataggtcagtaacacctctcctcacccccaccctgattgtgactaccaaaaatgtctctagacattgccaaatgccctctggggggcaaacgtgacctctgataaaattcactgtcacttatgaagattccttaattatttatttatgccttttatgaactagggttcccttgatgtaagctaggtacaggtgttgaatgaatcccttctgcagatgtagtgtatagcttgggcggtgcctgatatatgttggagaacactggaatatgatgaaatattttagcactattgggaatttaattgaaggttcgaaatgagctcttgttttgaaagtaaaggtgtaggctttctggctgtatctaaatctctgttttccacctctgccaccaacccctcatgcatttgcttgaaaaagatccttactagcttaggaatagttgagattccgaggacagttggacctgacgggcccgggtccaggcacacaacggcgggagagaagagaaggcggcggccggcaccggcgcctgtgcccatggagtcgggccacagaccctaaccacggagccaccccggctgggccccgcgcc

SEQ ID NO: 84346 - DNA, 111 bp, Homo sapiens
tactagcttaggaatagttgagaatttcgtttgaaatgtttgacatgatctgtctatatcttgtgttcaaggaaagatagttttgtttgtttgcgtgtttgtttgtttgtt

SEQ ID NO: 84347 - DNA, 6261 bp, Homo sapiens
ttttgtttgttttcctgccggaggctggaaaacggccgggttcctgctgcactaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccaagaagagtattcctttccacttacaactaaataagacctgcttttgctggagctgtgctaggctgagggaattccacactgaattttacaagcgggatggatttctctaaggcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaa

SEQ ID NO: 84348 - DNA, 6336 bp, Homo sapiens
ttttgtttgttttcctgccggaggctggaaaacggccgggttcctgctgcactaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccaagaagagtattcctttccacttacaactaaataagacctgcttttgctggagctgtgctaggctgagggaattccacactgaattttacaagcgggatggatttctctaaggcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaaaaaaattatatcttttcacataataacacattcttctcttaatttattctactaaaaaaaaattgggcccgaatc

SEQ ID NO: 84349 - DNA, 6207 bp, Homo sapiens
ttttgtttgttttcctgccggaggctggaaaacggccgggttcctgctgcactaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccaagaagagtattcctttccacttacaactaaataagacctgcttttgctggagctgtgctaggctgagggaattccacactgaattttacaagcgggatggatttctctaaggcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaa

SEQ ID NO: 84350 - DNA, 6385 bp, Homo sapiens
ttttgtttgttttcctgccggaggctggaaaacggccgggttcctgctgcactaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccaagaagagtattcctttccacttacaactaaataagacctgcttttgctggagctgtgctaggctgagggaattccacactgaattttacaagcgggatggatttctctaaggaagatgacatacaacgatggtttgggagtcttaatttgttggaaagtgaaataatgaatgatggaggattcatacacagatgtgtctcaacttagagtggggttacatccctataaacccattgcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaa

SEQ ID NO: 84351 - DNA, 4119 bp, Homo sapiens
tgaggccaacgaggccataagtttattttctcatgtttttgtcaccaaaatgcatttatttgtactttgcttacattggccccatatcagtcatgccggcctttttctttcattgcaggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaa

SEQ ID NO: 84352 - DNA, 5811 bp, Homo sapiens
atacataccttctactcagttcattgaagtagtttttctatgtaaagttattataaatttcagaggtatactattaaactgtcaataaaatataatttagcacatttctgaggttctaaaattagttgtttctttccaagtatacataggattacttttctttttcaacaacagattttctctaatatttgttttgttttgtgtttattccttgccttttagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaa

SEQ ID NO: 84353 - DNA, 3185 bp, Homo sapiens
acaggaaagtataacatgattctgatcactggccggtgtttgacactcaggaaagagatataactaagatatacgatgcaatgatatacgaattaaatccaggaaagagctctaattgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaa

SEQ ID NO: 84354 - DNA, 1732 bp, Homo sapiens
ttttgtttgttttcctgccggaggctggaaaacggccgggttcctgctgcactaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccaagaagagtattcctttccacttacaactaaataagacctgcttttgctggagctgtgctaggctgagggaattccacactgaattttacaagcgggatggatttctctaaggaagatgacatacaacgatggtttgggagtcttaatttgttggaaagtgaaataatgaatgatggaggattcatacacagatgtgtctcaacttagagtggggttacatccctataaacccattgcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggttttcttccattttcttgttataacgttcatatctaactctgaataatttctatgaattgcacaggaaatatttagtatttagtattatgggtgagaaatagtacagaataccactaatggtgtactatataaggtatgagaacttaaaatagtttgaaacttactgggtataaagtagttacaatgtaaacaatatagttgctttgaaaattggcatgtaattcacatgatatatcaccatttatatggaaatggaaat

SEQ ID NO: 84355 - DNA, 473 bp, Homo sapiens
cagcacagagcagtttcaccaatatagaaagttctgctggacagctctggtctaaatagaataagcctgagcaatttccttccagagcaaggttagttagttagtatagagtaagacagcagtccaggcctctttggactgcaccacaccactgctactggcaaaatttgtgacttaggattattgcactgctgtttgaaaataagtgctggtttgggatagtataatactgggtagaaatttaaacccactttaagtactgttaattaggatcagaatggaagcatttttctaaaagcaaagtttaacctattactgagaataagtgtgctgtttgtttctttcttctcttctagaatgaaaagaaaattttattcctgggaggaatgcatgaaccttcgggaggttaaggtatatattaatataccaaggaataatttatggatgattaaaatagctttgtacatgcttag

SEQ ID NO: 84356 - DNA, 266 bp, Homo sapiens
catcacagtcagtttttgctttgattattgtatcatagagagtttttgacaaattgagttctgcattaattttatctttgtagtctagtgtaagattcattgtgtattttgcattttaaaatcatttcttctctatcagggatcagtataagaaatggcatactctcgaatccaggcaaggaatttattccacctaatccatggtctagttctggcttgtctggaaaatcttcagggacaatgtcagtaatcagcaaagtaaattc

SEQ ID NO: 84357 - DNA, 6150 bp, Homo sapiens
ttttgtttgttttcctgccggaggctggaaaacggccgggttcctgctgcactaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccagcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaa

SEQ ID NO: 84358 - DNA, 6207 bp, Homo sapiens
ttttgtttgttttcctgccggaggctggaaaacggccgggttcctgctgcactaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccaagaagagtattcctttccacttacaactaaataagacctgcttttgctggagctgtgctaggctgagggaattccacactgaattttacaagcgggatggatttctctaaggcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgtgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaa

SEQ ID NO: 84359 - DNA, 6653 bp, Homo sapiens
ttttgtttgttttcctgccggaggctggaaaacggccgggttcctgctgcactaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccaagaagagtattcctttccacttacaactaaataagacctgcttttgctggagctgtgctaggctgagggaattccacactgaattttacaagcgggatggatttctctaaggcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaaaaaaaaaaaaaaaaaaaaaaaaaaaaaaaaaaaaaaaaaaaaaaaaaaaaaaaacaaaaaaaaaaaacacaaaagaaccacaaagaagataaaaaaaatagaaaaaacatggctaaagaagacccaccagtgcgagcatacgataagacataagaaggccgacgagaaaaaaacaaacacaccaacatcggagaacaaagataaagaaaggaacaaccgacacaaagaaaacacacaaaactaggaaaggaaaaccaacaaacacaaaatacacacagagaaacatcaacactacacggaaagaaaaaaacaaaaagcacaaacagcaaaaaaaagaccagatacaagcaaaaaacgcaacaggaaaaaaaagaaaaatacgcgaaagaaaa

SEQ ID NO: 84360 - DNA, 6059 bp, Homo sapiens
gggacaccaaaaaagactgactgcgtgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaa

SEQ ID NO: 84361 - DNA, 4736 bp, Homo sapiens
gtctcccttttctttgtctggtcgctccgtgtcgctcttcgctgtgtgttttgtcgctggctctcgtcgcggcgcccgtggcgtgctccgcctgtgtgtttttctttgtctcttttctttctttttgtttgcccactcctgggcgtctgagccgttgccagctatttgtcttcccgtttgtcgttgctgctgcgggtcatgcttccttgttgccggttcgggccattctggctccgtctgatttgccatttctacttcattactaataggagttttttcttctatatcatcaatgaaatctggttcctgattatttgatactgatagtctcagtggagaaagctttctttgtttagtttctgggctcttcattttgttggtcgttccttcacaatccacagtaatattctgattttgtgtatctttttcttttgaaatatctttgtcttgtttttccttttttccgtctggtctcataaccactattgatattttccatggattcagaactacgttttagaacagggcactctgggttttctttgaggcatgcacagtccaccttgtacttacaatttccatagtcaaaatcaaaggcaatagtaatttcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaa

SEQ ID NO: 84362 - DNA, 485 bp, Homo sapiens
caagagagagagagaggtgcaagccccaaagcgagcgacatgtccctttggggagcagtccctctgcaccccagagtgaggaggacgcaggggtcagaggtggctacagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggactcatctgatgatgtgagaagagttcagaggagggagaaaaatcgtattgccgcccagaagagccgacagaggcagacacagaagagtattaagaaagatgctcaagtcccatggcacagagcaaggcgggcagggaacggttatttttctaaataaatgctttaaaagaaaaaaaaat

SEQ ID NO: 84363 - DNA, 947 bp, Homo sapiens
caagagagagagagaggtgcaagccccaaagcgagcgacatgtccctttggggagcagtccctctgcaccccagagtgaggaggacgcaggggtcagaggtggctacagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggactcatctgatgatgtgagaagagttcagaggagggagaaaaatcgtattgccgcccagaagagccgacagaggcagacacagaaggccgacaccctgcacctggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctgagcttccgatgcggggagagcagagcctcgggaggggcacacagactgtggcagagctgcgcccatcccgcagaggcccctgtccacctggagacccggagacagaggcctggacaaggagtgaacacgggaactgtcacgactggaagggcgtgaggcctcccagcagtgccgcagcgtttcgaggggcgtgtgctggaccccaccactgtgggttgcaggcccaatgcagaagagtattaagaaagatgctcaagtcccatggcacagagcaaggcgggcagggaacggttatttttctaaataaatgctttaaaagaaaaaaaaat

SEQ ID NO: 84364 - DNA, 410 bp, Homo sapiens
tcctttttgcaccacacatttaataacctaggtgcagaattctagcgctatatgcagtccttaattcacatttcaaacctgaagaacatgtgcctacttctcaggcagacaacatgtaatgctaactgaaaaaatgtcactgaaatttgttatatttattgaaatcctaagtgatggatagttctgttgccttttaccatttccaaggaaaaagagaagctataataatagcaattgacaaagatactctcatttttcctttaccagtggtactagatattctcaggctgccgcagtggcttacacctgtaatctcaacactttgggaggccagtgtgggaggatcacttgagtccaggagttcaagaccccatctctacaaaaaaataaaaaaaattggctgggtatgg

SEQ ID NO: 84365 - DNA, 1481 bp, Homo sapiens
tgccccggctgcaacctctcccactcaagagaccctaggaacgatgaggaacggggtagaaatgaccaggggagccaaatctcaggtaccgagaccttccagctcacccctcaggctcaggaaagccaataacccacatatgcccaaaaggagcttatgtctcaactgagaacagcaaataggtgatgggccactttagaacagaggctaaaggctggtagccactgagcaaaacccaaattctaggcacctgaggtgtttcccttacacaagtgccttcacaggtagcaagcaattaatctgcaacagtgaacaacactaaaacttaaattttacatggaagtctctcaagtagacaaagttattattgggtggggttttccccccactggcaaaaaaataacttatcccttggctgttagattgagggaactataaaacaaatattttaattcgatcactgacaaagtcataaaattcaatgactgtttgtagaggaaaacatgctttcattatcttaattaaagcaagataagcctctctcaatgtgcatgcattttggagccactgaatggactggtgatgagacgaagcaacctttaattgggaccatgcttctccagtacattcgtttgtattccatggtgtaaaccgggccttacgcgtggctccgaccttcggtggaaatgcatttgcgtagcaccacccaggggctcccttgctttggctagagcctcataaaagaccccaggttttgcgaaggattttgaacaccagcgtcttttaacatgtggaactttcggttttggtttagctctgtgaacgtatttaaaacttgctacattattccacagtgaaagttggaacctttttaagagttatcatagagtgccttttaacatctgtcatattttctataaacaacttttcagtgagaagcgtatatagtgtactcgaggtaggcattagctgctggcaaggtttatgatacaatagtgacactacaggacaattttttagtcaaacaacacccgttagatatttcagggtccagcttatatgttaacttgtaaatataggttaaaaatataggtatcaagtgactaaattcagtatcagacaaattgaacatctttttatttcccagaagtgccctactctttctcctccctttggtgacctcttagtctggaatgctctgcatccggggcccctggaacacatagtttttaaagtacctattagtgatactctcctcccgttggcagtgcttccactgtgttttctgcatgtaataaaggatggcactgttttttgcataggtctttcctaatagctgagcactcttggagtgtaggggctcaaccttatgcctctttggacacacaagcctagcccatgggctggcatataggagctgctcaataaatgtttgttgaacgaatgagtggatacacgaataaaatattttcattgtcttt

SEQ ID NO: 84366 - DNA, 1834 bp, Homo sapiens
tgccccggctgcaacctctcccactcaagagaccctaggaacgatgaggaacggggtagaaatgaccaggggagccaaatctcaggtaccgagaccttccagctcacccctcaggctcaggaaagccaataacccacatatgcccaaaaggagcttatgtctcaactgagaacagcaaataggtgatgggccactttagaacagaggctaaaggctggtagccactgagcaaaacccaaattctaggcacctgaggtgtttcccttacacaagtgccttcacaggtagcaagcaattaatctgcaacagtgaacaacactaaaacttaaattttacatggaagtctctcaagtagacaaagttattattgggtggggttttccccccactggcaaaaaaataacttatcccttggctgttagattgagggaactataaaacaaatattttaattcgatcactgacaaagtcataaaattcaatgactgtttgtagaggaaaacatgctttcattatcttaattaaagcaagataagcctctctcaatgtgcatgcattttggagccactgaatggactggtgatgagacgaagcaacctttaattgggaccatgcttctccagtacattcgtttgtattccatggtgtaaaccgggccttacgcgtggctccgaccttcggtggaaatgcatttgcgtagcaccacccaggggctcccttgctttggctagagcctcataaaagaccccaggttttgcgaaggattttgaacaccagcgtcttttaacatgtggaactttcggttttggtttagctctgtgaacgtatttaaaacttgctacattattccacagtgaaagttggaacctttttaagagttatcatagagtgccttttaacatctgtcatattttctataaacaacttttcagtgagaagcgtatatagtgtactcgaggtaggcattagctgctggcaaggtttatgatacaatagtgacactacaggacaattttttagtcaaacaacacccgttagatatttcagggtccagcttatatgttaacttgtaaatataggttaaaaatataggtatcaagtgactaaattcagtatcagacaaattgaacatctttttatttcccagaagtgccctactctttctcctccctttggtgacctcttagtctggaatgctctgcatccggggcccctggaacacatagtttttaaagtacctattagtgatactctcctcccgttggcagtgcttccactgtgttttctgcatgtaataaaggatggcactgttttttgcataggtctttcctaatagctgagcactcttggagtgtaggggctcaaccttatgcctctttggacacacaagcctagcccatgggctggcatataggagctgctcaataaatgtttgttgaacgaatgagtggatacacgaataaaatattttcattgtctttagcccctctgactttcttttttaaacaggggtatgtcataaataaaatttaccttgaaaatgcatttaagtacactgttctacttctctgaccatgaagtttttaatgggacatcgttttaaaattctggtcattacaacgaaccacttttgaccttggttgacttttctcagaaccataattcgaagtaaagacaaaaacaatgagaaaaggcaaagagatcaaattttggttttctctttttcagtaggatatgatgtttatcgaaatttggaaacaaattgtagcaagcacctataacatgtagatactcatgtttttatattaaatatgacattatttataaaaccctg

SEQ ID NO: 84367 - DNA, 230 bp, Homo sapiens
caatctgcaaaatttcctattgttcttttgtgaggagaaataatagagaaacaccaaaaggccaaagtctagctccaccccgctctttgtattctcctcactgcccacctcccagcccccaccagtaattataaggcattgtgtattaagaggtatgatgtggcttccttcatccatgattaacacttacaccaatgcatattcattcatctcttagccctaccaaaccc

SEQ ID NO: 84368 - DNA, 435 bp, Homo sapiens
cagcctgtgtgacagagcaagactccatctcaaaaaaaaaaaaaaaaaaaagacatggaagatggaggcagctctgaggggagaactggagggccacagtgtccgtgacatgagagagaacacttcagaattcaaaggctcaaaatagttatcttctgagcaatgtgtcttaagaactaaaggttatgcaccaccaagacaagagtaaagtgaagatatgtgatccagcaacttgatgtgtctgagaatacaaacatgcaattctatcagtttgggaatgggtttataacaagtacacagaaaacaaaaaaatgaatagggaggcaatgattagctctaaggaaaacaaacaaaacaaactcactcaagaaaggaaaggcaatccaggcagctgtgagtgcctcccccagcaggacacagcctggaagctgcagc

SEQ ID NO: 84369 - DNA, 335 bp, Homo sapiens
ggaggacggcttgagcccaggagtttgaggctgtagtgagctgtgatcacactgctgtattacagcctgagcaacagagcaagactgtctcccaccaaaaaaaaaaaagttaaggaggcgggaacactttcgaaatacagtcatgtggtgcttaatgacaaagatacattctgaaaaatgtcttatcatgcaaatttcatagagtgtgctgcttacatagaccttatagcctatacacacataggttgtttagtatactctattattcctaggctacaaacctgtacagcatgttactatactgattaggtagttgtaacacaatggtaaatatt

SEQ ID NO: 84370 - DNA, 423 bp, Homo sapiens
acttgtgcacagatgtgttgccagtatcaggaacaatgcctagtacatattagttgctcgctagatatttgttgaaagaatgaatattaattaacaagagactggctgggagtggcggctcatgcctgtaatcccagcactttgggaggccaaagtgggtggatcacttgaggcccgagttcgagaccagcctggccaacatggtgaaaccctgtctctactaaaaatacaaaaattagccgggcttggtggtgcacacctgtagtcccagctattcgggaggctgaggcttaggcatgagaattgcttaaacccaggaagcagtggttacagtgagccaagatcgccccactgcactccagcctggacaacagtgagactcatgttcatgaaaaaaagaaataataaatatataaaataatt

SEQ ID NO: 84371 - DNA, 1065 bp, Homo sapiens
  misc_feature (721)..(721): n is a, c, g, or t
  misc_feature (731)..(731): n is a, c, g, or t
  misc_feature (735)..(735): n is a, c, g, or t
  misc_feature (758)..(758): n is a, c, g, or t
gtccctaacctaggactccctgagctgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctgccttgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgacgcccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtntgcaaaaccnaagntgtgagccctgtgctgccggganctccagcctgcagaatgcgtccagaaataaagatcctggtgtcctgtgtgatgaaaaaaaccacaaaacagaacacacacaaccacccccacgggaaacacatagtcagagcggcgcgccacaagcggagggcacaccagacggccgacccattgggtcgaaaacgctggacacacctggagccccacagactaagcgatgacaaccacgcggggaccaaccggcaggggacagccacaaaagagacacacacgaaccaaaccggaataagaccggggtaaccatgcgagtgagcagcccgcagacg

SEQ ID NO: 84372 - DNA, 604 bp, Homo sapiens
gtccctaacctaggactccctgagctgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctgccacaggttgggactcatcaggtcccagatggagctggaagtcctcttccctctgatgaagaatctttacaaactgggccaggcgcggtggctcacacctgtaatccggcgctcaggaggccaaagtgggaggatcgcttgaggccaggagttccagaccagccttggcaaaatagcaagatccccatctctgc

SEQ ID NO: 84373 - DNA, 391 bp, Homo sapiens
tttgaggccaacgaggccaggttttgggttttttttttattttgcatatttattaatagtaagacagacgttattgtgtctccatttcttacaggtagggactgaaggttggagaagcatattaactgctccagggtcatttgaagctgggctgcaagtccaggtcggctgacctgctcctaggggtctctgaagcaaggaatgttcccatcaggtccttatcgagggtcttcaagagaaagggctgaagggggccacccaggggataggatcgtgtcaggtgtgctccatgagctaggggtcccttggtcaggacagctggcatgtgggggtggtgtaaggaggttccgcccaggagtccctcggtgacagttctgggggcgtcactgag

SEQ ID NO: 84374 - DNA, 705 bp, Homo sapiens
gtccctaacctaggactccctgagctgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctgagggactgaaggttggagaagcatattaactgctccagggtcatttgaagctgggctgcaagtccaggtcggctgacctgctcctaggggtctctgaagcaaggaatgttcccatcaggtccttatcgagggtcttcaagagaaagggctgaagggggccacccaggggataggatcgtgtcaggtgtgctccatgagctaggggtcccttggtcaggacagctggcatgtgggggtggtgtaaggaggttccgcccaggagtccctcggtgacagttctgggggcgtcactgag

SEQ ID NO: 84375 - DNA, 1133 bp, Homo sapiens
  misc_feature (789)..(789): n is a, c, g, or t
  misc_feature (799)..(799): n is a, c, g, or t
  misc_feature (803)..(803): n is a, c, g, or t
  misc_feature (826)..(826): n is a, c, g, or t
gtccctaacctaggactccctgagctgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctgagggactgaaggttggagaagcatattaactgctccagggtcatttgaagctgggctgcaagtccaggccttgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgacgcccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtntgcaaaaccnaagntgtgagccctgtgctgccggganctccagcctgcagaatgcgtccagaaataaagatcctggtgtcctgtgtgatgaaaaaaaccacaaaacagaacacacacaaccacccccacgggaaacacatagtcagagcggcgcgccacaagcggagggcacaccagacggccgacccattgggtcgaaaacgctggacacacctggagccccacagactaagcgatgacaaccacgcggggaccaaccggcaggggacagccacaaaagagacacacacgaaccaaaccggaataagaccggggtaaccatgcgagtgagcagcccgcagacg

SEQ ID NO: 84376 - DNA, 327 bp, Homo sapiens
atcttttgttgtgttagaaatttattgcattgaatagtatgtagttaattatattgttgcaaagctatttatttgtaagctaatcttggttaaccaggagccattgcactggccggagtgcaatggctcgatctcggctcatggcaacctccgcctcctgggttcaagcgcttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaa

SEQ ID NO: 84377 - DNA, 823 bp, Homo sapiens
gtctgtaacaattttaaaataaaagccagcatattggtgggaaaaaaaacaaaaatccaacaacaacaaaaataaaacacaacaaggcatatacttccaatatttccactgtataaacccaatccatggattatgcaaaagagataagtctcttggaaatgacagtcatttggtgacaataacaaatcagcaacagaggagactttaacgagttactcactgtttcctccctcaccaaaggcatctgctaagtcaaagtctgcccctaaaggaaggaatcggtctgttcatagtaaagctctgagaaatgaggaaggaatgacctcggaaacagatggagaaatcaccagagacccacatgactaaagacttttctgaatatcacactgactaggatctcatttgaaaaagtaaattcctgatcattttcacatcattcttcccccagatgaaaagagtaagagatgacagcaagagaaagagggagagagaaagaatgtcatttgtaaatcaactgtgctgcctggacccagttgggactctgaatctgcctgcacacaactctgtcccgttgattccccattatctcctcccaggtccccaacaccttcagcaaggcagaccgtaagagaaataaacagaaaaatagtggacatgaaaatggattcagagtaacaaaaacaaggaaaaaacactttagaaacccattgacagaatcaacaagaggaagagacaaatcgaatctcaaagaaaaagctcaggccggcatggtggctcacacctgtaatcccagcactttgagaggctgagatgggcggatcac

SEQ ID NO: 84378 - DNA, 221 bp, Homo sapiens
gagcaagactccgtctcaaaacaaaacaaaacaaaacaaaaaaactgaacaatctctttctctagatttccatatgattttgtttaatcttctgtcctttgcattgcagaaacacacacacagaaattcacaagagtgtgaggtatgggactgagcatgcacaggacccattttcaatatttagcccatatacacccatgtgtgcatgtacacacacacac

SEQ ID NO: 84379 - DNA, 784 bp, Homo sapiens
gggatgtgatccaatgcatggtgcttaagagcgatggccagtggctagcctaatacccagtggcatggctgttttatacttccttttgtttgcaggtgtgctctatagtgggggtgggagagatgcctccatcaccagatctgctcctgggccctgggggagtctcctgcaatcactgtgtttcttgtgttaggtgttctaggccacaggtctctctcaggcagaggccctttcctaggagccattctggggaactagctgtagtgtttgggttccctgcacaggcttcctccctcttcaactcagcttcattgctgcctctccatccactcagcattttctctctcaagatctgcctaaattacggtggtttactccataatttggtgtctctcagtgggggtggtgcttcctgaccatgtcaaattgaccatctattgtcacagaatgaaaacctctttgatagactttgtaacatttttgaatattacattcaggagtaaaatcttacgcagtgtgatcccagctatctcttcgcttttgagaataaccttaagtaattaaaggataattaaatatgtaattaaaaattgaaaaatagaacagctacacttccagatctcaacttctttcagaaaattttaaaatctctttaaagaaaggtaaattgagaccaaaatagactaatagcttcataaaaataagtgctcaaggagggtgttacatgtgaaaattaaacttggaatttgtcattttacccgtaaaattactgagagtaatttcc

SEQ ID NO: 84380 - DNA, 357 bp, Homo sapiens
atcattggtagtttaaacttttcatctaatattagattgcatgcaggattttatatctaattactctggcagatggcctttagaaagttcaaaaataaaatgcagcaattcatattggcagatttactattgagaccaatgctttcttaactaaaaggttttgtttaaaatcgttagtttaggaaatctgataaagatttttgaatatcagagcgtttaaaagagattcttactttacatctggcatatttcttgtgttacatattataatttcattgaacatggctgtctgtaaaactatgtatatgatccggaagagactcaaattaaattaagttttaacagccatcaattcat

SEQ ID NO: 84381 - DNA, 321 bp, Homo sapiens
tcgaacttgaagcagaaaaattacctctgtgatttgtaaaatcaggcatttcaccatttctgtatttgcaaaggtaattcaagtctaggtagagtagacttagattttgggttttttaaagtgtgttcttaaaataatgtagttaatgttcccattattcatttctatcacagggcatacagtctgggcattcctaataatttttctgtctttcttgataaatgagttagttttagctatacactattttatcacttctctgtatggatttttctgacgcctgcttggtgttacatttagtagagctgtctacagtgtgtg

SEQ ID NO: 84382 - DNA, 468 bp, Homo sapiens
acctcgaaggtcgagcccctggacggcggagggactttggaaaagctcggaattgaccgaggggagccagagaagaggttggaaaccttttctcccaccacgggcggtttaagatggaggaaaacgctcttttattgaaataaaagaagtctaagctgacctgcggttgcttctttaggagagtcgacgtgtctgcgtccagcgcgcccgggctgagctgcagactcgcgcctgccaccgccaccctctgccaccttgccctgttttgtctttatggcgcttccccctctgaaatactctttgcggggagttttgtggctctatcactcgcttcttccctggctccccagatgcctggagagcggggacctacttggtccccaacgtccagtccgcagcagggctccgtcactgtctccagagactgaacgaatgactttctagcagtaaggaagtccccgctggccc

SEQ ID NO: 84383 - DNA, 418 bp, Homo sapiens
aaaaaaaagcctcccttttcttttgtctctgtcttcctcatttccctctctttttgattctggtcccaaacactgagtagatgcctactgtgtgcccatcttgtgttgggccctgggcctactgagataggttagatcctggcccagccttacaaacatgaggacaaacaaatgaacaaaacacaaaccttcacaacgaacttccaagcttgatcttcccagctccgctatgaaggcgtgatgaccccctctccatttcaaagacagaaaaactgaggttcagtgggggatgtcacttgcccaaggtcacacagaaagtagcaaagctgtcctttatacactgacacacatttgttgggcacccactgcttggaagggagatggataatatatttctgtaaataattctgagcttctg

SEQ ID NO: 84384 - DNA, 372 bp, Homo sapiens
tctgccttgtcagtgaagaaaaaaattgtagtgaagctttctattaaattccatttataggaagcatcaaaggggggaaatgaggcaggaaattaaagaaagaaagaaaaataaaatttaaaagagcaaaacatgctttctatattaggctgaatcatcccaaaggcagtaacaggcaaaacctggacccaggtgaagtcttgataacattatctaagaagccaggactgaaaggaatgtgctctggagacttccagcattccctccacaaagggagaagaaaacaaattttcctttcccccatgatatgagtaaacttatgagtttatagatttctgttttctgtaactagtaacttcaagtatcctgttt

SEQ ID NO: 84385 - DNA, 858 bp, Homo sapiens
  misc_feature (733)..(733): n is a, c, g, or t
aaggcaggcagatcacttgaggccaggagtctgagaccagcctggccaacatggtaaaaccctgtctctactaaaaatacaaaaaattagcgaggcatgttgtcccagttacttgtggggctgaggcaggataattgcttgaaactgggaggcgaaggttgcagtgagcccgagatcacaccactgcactccagcctggggcaacagttacgatgaagctctgtgaaatactcggaagccaaacagaatcaagtgataattgaatgctgaccctgagcaactcactgatagatgccgtgggggaagtacaaagagttataagggaacagtcaagcaagagcccacaaaagaaatggacaccataagaagataccattatgttagtgcattgactgtaaaaaggatggcattcaactaagaggagcaacattttgatggaatttcaggcactataataaagtgaagaatcctgaaaaaaaaaaaaaaaaaaaaaaaaaaaaaaaaaaaggggggggggggctaaagagaatatcccccagggggggggcccccaagtaaatagaggctacacaccaccacaatttttgtcttgggagcagccagaagtggggccccccccccatagaaagaaggacaccaatcaataaatagaagcaggagacgagccacgggcgagacgcgccaagacgtatacaaacacacagcgcctctgttcacgcgtggggaaaacacnacggctgcgtcgcagctgggcgggacacacacctgtgggggaacagaaggagcaaccacctaatacagatgggggggaggggggcgagacaccactcatacgtcgggggcccacagagatctccc

SEQ ID NO: 84386 - DNA, 684 bp, Homo sapiens
cggccagttctcagtgaaatgagaaaaatgcataagtacctgttacaaatatctaaatggaagaaagctatacatttagatatttgtaacaggtacttatgcatttgtggcaaactttaggtggggtcataagctattccacatttttcagaaggccactaaaaacaaccacagacttccttttggaatattaatttcagcatattattattgtagccaagcagactgttttgttttcagttaaagcttataaaaaataattaaacctaacacatgataaattttgttttcatatacaaaaaacccagagacagatggattcccttcattgcagttggtgatatttactgaaagaactaacataaatttgatatttttcctcttgaagaaaaaaatgggctggtcacggtggctcaaacctgtaatcccagcactttgggaagccaaggcaagaggatcccaggagttgaagaccatcctgggcaacatggtgaaaccctgtgtctaaaagaaatacacacaaaaaattagctcagcatgctggcacatgcttgtagttccagccactcgggaggctgaggtgggaggatcacttgggcccaggaggtcaaggctgcagtgagccataatttcaccactgcaccccagcctgggtgacagagtgagaccctgtctcaaattgga

SEQ ID NO: 84387 - DNA, 593 bp, Homo sapiens
tggcgctgccgcctgaagagctgtcagtcctactttgcagttgagctggctctgagaagaaagtgctctgcctagccctgtgattgatccacaacttcatggggactcaaacatgggttcttttattccaggtggagaaattgaggccccaagcaggggcagactcactggggtcacatggtgagttggtggcatgaatgggtgctccggtctacactgtaccacctcctccaggaagccttcctggcttggtcaagccaggcctggggtggtcaccacctgatgtcacatccccttgagacaaagccccccccctcccccgccaccaggcacctatccccagtgtccaggacatagctactggattcaggcagcttctgcagatgagctcccagccctatgtccaggaggtttctggaatcgacagctctccatgccacaataccctccatggctatttagggaacacccagtgtgtgccaggttcggctggcctgggagagtgcacagtggacactggtcaccaggagacacagggggccagtccacacccttccgcagtcgggcctggggaatgggttgggtactgacct

SEQ ID NO: 84388 - DNA, 798 bp, Homo sapiens
cccaaattgaagaggacactggattcctctgatggagttctgctccctagagctgatgctgcagatgctgctctcagggtccttgggcttgcccccagccaatgggaaagagaggtcaagactgtgctcagcttggtggacctgagacatcgaggatccttctgaaaggatggcctgaggcttggagcgtcagaggaagtctggggccaactctgcctctctgagcttcagttttctcttctctgcaacaagagcattgggctgtataatccctagaaggagacccttctgctcagtaagctcagtttagctctgtgtgtgtgcgtgtgtctgtgtgcatgtgtgtgtctgtgtgtgtgtgtgtgcatgtgtgtgtcctttgaggtccctgagcactcaaatgtagctaattcagactccattgattctgaacgtataatttttttgacttggactaggctggaagctacttttgcataattcacacacaaaaaaacttgatacgctcatgaatagtgttgctgtgatgatggaagaatcatttccatgacaccgggctgcctctcatcaaatgcctttcagattcaagcaacaaagatggagctccctcttcctgccaggcacccccccggccctacaacccctagactctcttgagccttcccatttgtgtcctaggagactttcctgagctccaccgtccaactcactaattggatcttcactgtgctcattcctttatgcagtctgtccattatgattttaattcttataagcatattttaaagtttgagaatc

SEQ ID NO: 84389 - DNA, 112 bp, Homo sapiens
gagctgaatgtccgagcaatggatagaattagatggaaagagctctcaatttggcctgagactgtccccagatactcaggaaaaacaggacgtcgcacagagtgggcagcag

SEQ ID NO: 84390 - DNA, 503 bp, Homo sapiens
tacattgtttgtgtaccattgtgacccatatgttaaatgttgttatgaaaagctgtgttaccagttttccaggaggttagaactccagcttttatgttaggatgctaaactagatattctaggtattgtgttgtttcttatgcattaacgttcacagagaaggagggttttatccaaatggaagggctggattaagcacaatgcagtgttgaagcagcatccgcctactgttggactgaaatgagcattcctttcttctcttagaggagaaaatgtggggcctatatatgactagtggttgttgatgtttggcttttgtgcgccctcagtatatgaaatacccttcctcaagaaaaagcatacgttggctgggtgtggtggctcatgcctataatcccagcactttaggagtctgaggcaggcggatcacttgaggtcaggagtttgggaccaacctggccaacatggtaaaaccctgtctctgctaaaagtacaaaaaaaaa

SEQ ID NO: 84391 - DNA, 265 bp, Homo sapiens
gatcaaagtagtggcacctgcttcacaaggttgctgtgggaatgaaataagatagggtatgaaaaatactttgtggcacaggcatttaatatgtgccatttttttcctctaacatataataataagtgcagtttggttgatccttactatatcctcagtctgtttcttataactattattttttataaaatacaaaatgttttttattctttaatctttacataaaaccctgaaagataagtatcattgttttaaaccccatttt

SEQ ID NO: 84392 - DNA, 363 bp, Homo sapiens
gagaccagcctgggtagcatagtgggacctcatctttataaaaaaataaaaacccttgtatttgagaaggattctccaaacagggctcttcgtaatacctctctattagtcttttcccccataaactgctcttcagatggctcaatcttcatgtgttagtttgagggacttaggcctacagaaaacaaatgtacatttgtcaattccaaaattctaaaggcattgcactcacatgctctttctcatgctgtgcagtatgtatttcttgaaagatcgccaaagactgatttcaccctaatgctaagggcaggatttttatcccatagctgagaggggcaacacatgaataacagttaattctag

SEQ ID NO: 84393 - DNA, 297 bp, Homo sapiens
atggtcttgatctcttgacctcatgatctgcctgccttggcctcccaaagtgctggaattacagtgtgagccactgcccccggcccatgcccagcctttttgatttttcagacaaggtcttactctgttgtccagaatggattgcagtgacacaaacacggctcattgcatcctcagcctcccagctacacaggaggctgaggcaggagaatgacatgaacccaggaggcggagcttgcagtgagctgagatcacgccactgcactccagcctgggtgattgagcaagactgtctca

SEQ ID NO: 84394 - DNA, 239 bp, Homo sapiens
ctggtctcctatagggaagatctttagtgctccttatatttgggccaaaaactagcagaagagcaggtagcttttccggaaacagtccgacatgaggagggtagctggtaggaaggagagatgcccagctcatagcgattctggttgaatagggcattcaggatagaaagcggaactgagcacattaacaaaataacatggtagaatgttctggaaaagggcctaagcctgccgtagcg

SEQ ID NO: 84395 - DNA, 536 bp, Homo sapiens
tcgatgcccttagaaaaggggtacaagggagcacattctgtctttccattgtgcaaggacacagtgagaagacactgtctgtgaaccaggaaatgggccctcaccagaccctaattctaccaggactttgatcttagacttcccagcctccagaaccaggaggaataaatgtttgttgttcacctggtccatggtattttgttagagcagccccaactaagccaccgcctctctagttcactattctgtccccggtatccagggcatcatagacactcaacaaccattcgttgaatatgcaattggatgaaatgaataaacgaccagaggagtaatccagacagagcagcagtggccaagggaagggaggattgatttatgggagaaaattaggggaatgaaatccatagaaagggtttgcctaagtgagagtgatgactggagccagaagacacccgggggagaggaattgtttcacatggtaggaaaaggggaggagggagagaggtggggtggtggagtgcagcctcgaggct

SEQ ID NO: 84396 - DNA, 276 bp, Homo sapiens
ctttttctgacaactcccaaataatagatttggttgctctagctttctttattctaatctgttttctcttgagaatagagcatatatgtgtaaataaatgtaaatttacacaattatttcatagtaatggttaacacaaattgattagcatcagtctctgttcagagtgcttggaatgcacatgtgcattatttaatacctgtgacaaccatatatgtactattttccctgctttacaaatgaggaaactgaagcaacagtgagtttcaattagta

SEQ ID NO: 84397 - DNA, 394 bp, Homo sapiens
cgccagtcactccccacatcacaactcccccagccccaggcaaccccagcctacttgttgtctctacacatgtacctgctctagacagtccgtatacatgaagtcatataacgtggctttttgtgcctggctgcttccacttagcatattttttgaggttcatccatgttgcatatgtcagcacttccttccaaaattgctgaattagattccgctttagggatacaccacattttgctcacccatttattagtcagtgaacatttgacttgtgtccccttttttgctgttgtgaacaatgctcctatatgtatgtgtacaagtttttgtgtgaacatatgttttcagttctcttgggtataggaatagaattgtctgctgatttcttttgaat

SEQ ID NO: 84398 - DNA, 154 bp, Homo sapiens
ccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcg

SEQ ID NO: 84399 - DNA, 428 bp, Homo sapiens
tctttctttgactttttgatgtatcattatggactcacggattattatatatttaatgtgttttgatccagttcagtcatcattctttggtcagtgggagctctttcatcatttttgctggaaaatttaaaagtaatgggcagagataaatgatattttacctctaaatacttgagtatgcatttctgaataaagaaggaaagcttcctgcataatcacagcttcattaccccactaacaaaatccatcattctggccactatattcttttttcatatttccaataatctatgcatcttaattcagctgctttctgccacaacaagatcttccagccttatcttattacacatttcctgcaccagacctggactcagctacttactgaggagtccatgggtctttaaagtggggaaatggcatttaga

SEQ ID NO: 84400 - DNA, 166 bp, Homo sapiens
gtgaaagtataactattatatgcttgaaatttgtgaatacagtatattttaaatgtcctcaccacacacaaaaatatagactatatgaagtgatggatatgctgattaacttgattgtggtaatcatttcacaacgtacacatatatgaaaacatcatggtgtata

SEQ ID NO: 84401 - DNA, 406 bp, Homo sapiens
attcttggtggtgtcattaactttagtgagaaattaaaagaacacattgtagcaaccaaatactgatacattactactatgatcgtgttcatcttgtgcttcccactgactgtgcaattctgctgctgcatccaaaattaaaacactgggttgctttattctagtacagcctcatggaaatcggctctctttcaaatctttaaagtagaatacgggtctcacctgccaccatctgactttaccgatcttctggaggatgcatttcttatattctgccaaacccactagtaattacactataacttcttactatgggttgtatttagttgctcctttaatttctgcaacatgaagaactggtcaggatctttccttccaccatgataaatgacaatataattttgtt

SEQ ID NO: 84402 - DNA, 409 bp, Homo sapiens
tctgaaagataagcagaggctggattacgaaggatcttctgtgtcaaggaatttgaagattatccctaggcactggatggtgttaggtatgggcgcaggggagtgagcagagcagattgtgttttggctgctgcacactggagaggggtgagcctggttaggagggagttgcagaggtgctggcaagaacttctgccagaagggcagaagggtagccatagaagggtacccagaagggtagccttagaaatgggaagagggttagagggttggagagactgagacaggccctcagtctgaagaagtagactgattggatatgggaagatacagtgtggatgtaagttgattcttcagtttctggcttacataactaggtacatgctaccaatgatagagattgtgtatg

SEQ ID NO: 84403 - DNA, 218 bp, Homo sapiens
ctgtagaaacggaaaaatcagcatttattctcttttaaaatataccttaaaagttaccaacaatcacctgtatttaatctataaagtatattcaacatcacaaatcagaagcaattaaatctattcagatacagaggaaccaatacatatttttttcttttcttttgagatggagtcttgctctctcacccagactggagtacagtggcacaatctta

SEQ ID NO: 84404 - DNA, 404 bp, Homo sapiens
tagtttaaaagtagccacaattacattacattgttattgattacattaatcaaatgaatgtggctttgttccaataaaactttatttatacaagcaggcataatttgttgaccattatattaaataatgataaaataaagctatcatgattaaaaaccatctaaaaattatatctgaagataaacttttataatttttctgtagtgtttaaagtccaaagatattcaatccagtgctaagaagtctctttatacatgtcctgcttaataatgaaaaacaggaacatattattggtaaaacatttattctttcttattgcagtaataaagtggattaaatagtacaaagaaagcaatattttgtttgtattgtttgtttgtttgtttgagatggagtctcactct

SEQ ID NO: 84405 - DNA, 390 bp, Homo sapiens
atttttagtagagcagcgtttcaccatgctggccaggctggtctcgaactcctgacctcagatgatctgctgccccagcctcccaaagtgctgggattacaggcgtgagccacacctggccgtttgttttaattttgaaggtgaagtgaaagtgactacatttaccaaaagtgattgaaaagccaggactgttcttaccctgtttttccagttcttgctcagagcaaggtggtttctttttcacttaatcaccatacttacttttcatgtagaacaagtcagtttgagttatcagttcatcatcttaactaaattccatgggggaaggaattagttttagtttcttaaacttccaggtttgcttattggacaaaatgagatagcaaggca

SEQ ID NO: 84406 - DNA, 779 bp, Homo sapiens
attttgagaaatagattaatagttatcttgtattttatttttattacaagttctttaaaaacaacaagaaagacgtgagtctttctgtctctccagtcctcaggggaaagcagtgttggatttctccagggttttatctgtgcttctcctggagccaggtgtggggacagcgtctccagcagttctccctcccctggtgtggtggtggagcccagcctccaggaggacagactcagcgagattttattttgaagtttgcacattctctaaagcttttagggtgctgtttgtgtagaatggagaaagggttatttaagtatttacttctaaccctgctcatgttaactgtataaagccaacagaccctaataagagaaaattataacctaaattaatatagctcagggccagtatgtctacatagttctattttgctctagttgaaatactaataaatgcagtaagaaaacactatgtctaaaatgttgaaattctttgaaattcttttaaagctgatagattcttgcatagtagtagggcatgaggattcaacatttctcccccatcaaggtctgatttgatcagaactaaaggatgtaaagacaaaatattaccatcaatttaggatgggggtctaagtcaagcacagtggcttattcttcgtatttctgtcttagatttggttctactatttatccacagactcactagttcataatacaaatgaggtgatataaaagcactgtcaggccaagtgcggtggctcacacctgtaatcc

SEQ ID NO: 84407 - DNA, 557 bp, Homo sapiens
actcagtggggtctcatctgatctgcatacttttactagactaatattttttcctccagtgacagggcttactggcattctctaccttatattcttacgtattggtaaaatttagaaaacctggcatagtatggacaaggtgagctcaggttcttggctgctgttttccatgttacctcctttaatccttataatacatctgtgatataggtttggttatccccatttggccgatcaaaaccaaaggaggcctcctctggagtgcaagttagagacccaggcctgataatcagaaccttttcttttttctacatgaaaagccaaacatacacttgtcttattctgctctacttttacacgaggagttacatttggaattttgaaaacgtctattccatggtttactctagccattttcattgatcttttggaaacaaaatcttacttttttttccacttagtgttctagaactaaaggggccgatgaaaatctatgtgatcctgcaaagaatgactgggctaaaattagatagtatggaaaactgagccattatgtt

SEQ ID NO: 84408 - DNA, 523 bp, Homo sapiens
actcagtggggtctcatctgatctgcatacttttactagactaatattttttcctccagtgacagggcttactggcattctctaccttatattcttacgtattggtaaaatttagaaaacctggcatagtatggacaaggtgagctcaggttcttggctgctgttttccatgttacctcctttaatccttataatacatctgtgatataggtttggttatccccatttggccgatcaaaaccaaaggaggcctcctctggagtgcaagttagagacccaggcctgataatcagaaccttttcttttactactaagcttagatggccattggaaacaaacagtccggagaccgttcttccaccacggatcaagagggggggggcaggtatcagggataagattcatttagccttctgagcttgctgggcagactgggtgaccttgccagctccagcagccttctggtccaatgttttgatgacgcccaccgtaagtgtctgtctcatatcacgaactggaagcg

SEQ ID NO: 84409 - DNA, 929 bp, Homo sapiens
gatcatagtacatgtacatactaaatgaatatatcaacatttttctgtgctatttcaaaggttcagtaattttatttcataaaggtatctaaaaagactaaaccagtcatcttaaatatattaccactaaagcccaatatccacctactgtctgaatttggagagagtatggctaatgttagatactaaacatggtgagaatcctctcagatactggtttcagagagctgtcacccatagaaccaagggctaaaaagttactcatctttatggtataattttacttcaatctaacaaaaatttactgagcatctacagtgttctgggcctcgagccaggtgctgggacacagaggtgagccactcatgagtcctccccatgagtctctttagctggagaaccactttgtctagagtgtgtgattttgcacttaacctctctagagtctatggtgtgtgagatgaacagtgtaatattgttttgcatagagaggatactgtagacagaacccagtgatggagccttaagtaaagagtataattttggtgtgtggttggtagaatcactataatgtaatgtgacttaaaccttagacatcaatcattattttggtactttaaatataactgatgttttattccttgtgactacactatttagatatttacattaaatatcgaaaaactgatcacaaagatactataatacttttatacatgtgtgtacgtatgtatatatgtatgtatgtatgtcaatgtatgttttactattggcattagtaattattttccctttatgcaatttcttttagagtgcttctgtcttctcctcctacccaatagtaccatgaaattgtattattaactgagctatagcaagtcataatgatcatttgaaatcatttattaaataaatgaggtaaagatgta

SEQ ID NO: 84410 - DNA, 379 bp, Homo sapiens
tttattctaaaagcaggaggaagcccccttggactatcttgagcagaagtcaaagagatttgttatgaagtaggttttttttggctctagtgaaaaagaattggaaagtccacaggggtgtccaaagaagagaatacagtcatgggttcttagtttctatttctggttaggccagtagaacccctttctcatccctcttttcccattatcactagagagaaactaaaaaggatggcttcaggctgctaaaatacagactataagagactataaaagcctaaaaacaaaacaaaacagaacaacaacaacaacaacataaggtgggttggacaagcttgcctgaatactgggaggccagttaggagaatgttgcagtaaa

SEQ ID NO: 84411 - DNA, 1168 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84412 - DNA, 1519 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgccaaaaaaaaaaaaaaaaaaaaaaaaaaaaaaaaaaaaaaaaaaaaacaaaaaaaaacacaaaaacaaaaaagaaacgaagaaaaaacaaaaaaggggggccccagaaaaacaaaccacgagaggggcacacaaaacacgacgaccaacgacacgcgaaagaaagagaggcacgaaaaaagagggagagcacaaaaaagagagcagagagagcggcggcagaaaaaaaggcgggagagaaggagacacaagcgagcgagagagggaaatgggaaggagaacacacaaacagcgggggggcgacaacaaaagggagaacaacaccacagaggagaaagcaacgagaagagaata

SEQ ID NO: 84413 - DNA, 1325 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgccaaaaaaaaaaaaaaaaactctactcgtgccgctcgtgccaattcggcacgagctctttttttgatttcaatttcagaaatatcccatgtcctgaataaaagctgcggcttgagtacgtttattatggaacactttagggtgtttgacatttctttta

SEQ ID NO: 84414 - DNA, 1475 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcagggtgagccggggccatagcagggggacgcacggcccagaatggctcctgtacctcaaggctggcctcaacccaccggccaaccagcgcgcccgctgccgagcgcagaggagggaaggaatagccccgttgtggtgggatttaagcgtcctgttccacgctccagaacccttgagatgggaaggaccttggagagcacctgataaagcctttccgttccctattgccgcgatggggagcttgtcccctcgaggcaaagagcatacaggcgtgttgggatgactgggttttgctggtcttcaatctgtaacgttggaattgttttcactaccctgcctcttcttcattctgcctgattctccagaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaacagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84415 - DNA, 1259 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcagggtgaggactaaagaaaccaccagatggaaccggccttcttggaggtcacagcctcccatttcagcatcatgaagcccttctccctttctagggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84416 - DNA, 1255 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcagtgagtatggcaccttgggaggtcagggttagggatatgttaaggggagcttcagtatgcctcaggccctgactctgttctctgcagtcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84417 - DNA, 1055 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagcatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84418 - DNA, 1354 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagaggtgagtaataggagggatggggcttggccttcctcaaggtcaaaggaggaatgccattcagtaaaagattttaatggctctgtcttttcctttctcagctccttcggcattccctgcagtgcagtacctatctcagccacagccacagccctatgctgtgcatggccactttcagcccactcagacaggtgataacatcccatgcaggagctctagctctcaggtcctcccctccctgtttcattctcatctcacatgcccctcttccccacctaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84419 - DNA, 1454 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcagggtgagccggggccatagcagggggacgcacggcccagaatggctcctgtacctcaaggctggcctcaacccaccggccaaccagcgcgcccgctgccgagcgcagaggagggaaggaatagccccgttgtggtgggatttaagcgtcctgttccacgctccagaacccttgagatgggaaggaccttggagagcacctgataaagcctttccgttccctattgccgcgatggggagcttgtcccctcgaggcaaagagcatacaggcgtgttgggatgactgggttttgctggtcttcaatctgtaacgttggaattgttttcactaccctgcctcttcttcattctgcctgattctccagaggaagaagaggtggataagatgatggaacagaagatgaaggaagaacaggagagaaggaagaaaaaggagatggaagagagaatgtcattagaggagaccaaggaacaacagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcagctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84420 - DNA, 1629 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcagggtgaggactaaagaaaccaccagatggaaccggccttcttggaggtcacagcctcccatttcagcatcatgaagcccttctccctttctagggagccctggaggacacaatcgcccaggcaccctcatggcagctgacagagccaaacaaatgtttggaccccaagtgcttacggtgagagtaggattggatgcctagcccctagtacttccatccatgcatccttgccaccagtattcaagtcacaaacatatcaagcacttaagtttagggggaaacggggcatacagatacacacaagtcactgggtttcagctttcaaggagtttgtaggcgagttctcattctccttccttagacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagaggtgagtaataggagggatggggcttggccttcctcaaggtcaaaggaggaatgccattcagtaaaagattttaatggctctgtcttttcctttctcagctccttcggcattccctgcagtgcagtacctatctcagccacagccacagccctatgctgtgcatggccactttcagcccactcagacaggtgataacatcccatgcaggagctctagctctcaggtcctcccctccctgtttcattctcatctcacatgcccctcttccccacctaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84421 - DNA, 1439 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcagggtgaggactaaagaaaccaccagatggaaccggccttcttggaggtcacagcctcccatttcagcatcatgaagcccttctccctttctagggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcacctgctctgcgcgcccagtgcacccgtccagggcgtcgtgcagtccatgcgccgctggagctcgcgttgctgtccgcgcccaggctgccgctgtgcgagagtgcagccagacaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgccaaaaaaaaaaaaaaaaactctactcgtgccgctcgtgccaattcggcacgagctctttttttgatttcaatttcagaaatatcccatgtcctgaataaaagctgcggcttgagtacgtttattatggaacactttagggtgtttgacatttctttta

SEQ ID NO: 84422 - DNA, 655 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcagggagccctcggaggacacactcgcccacgcaccctccatggcagctgtacagagccacacacactattttgaccccagtgcttacgtaccccgcactatgtgggcgtctgcgctgctttttctagggacaccagaacattggacattacctcgggagtactagtaggaggct

SEQ ID NO: 84423 - DNA, 756 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcagggtgaggactaaagaaaccaccagatggaaccggccttcttggaggtcacagcctcccatttcagcatcatgaagcccttctccctttctagggagccctggaggacacaatcgcccaggcaccctcatggcagctgacagagccaaacaaatgtttggaccccaagtgcttacggtgagagtaggattggatgcctagcccctagtacttccatccatgcatccttgccaccaggacttgtgggttgaacgaggcttgtgggttggccgtgg

SEQ ID NO: 84424 - DNA, 1529 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcagggtgagccggggccatagcagggggacgcacggcccagaatggctcctgtacctcaaggctggcctcaacccaccggccaaccagcgcgcccgctgccgagcgcagaggagggaaggaatagccccgttgtggtgggatttaagcgtcctgttccacgctccagaacccttgagatgggaaggaccttggagagcacctgataaagcctttccgttccctattgccgcgatggggagcttgtcccctcgaggcaaagagcatacaggcgtgttgggatgactgggttttgctggtcttcaatctgtaacgttggaattgttttcactaccctgcctcttcttcattctgcctgattctccagaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84425 - DNA, 970 bp, Homo sapiens
ggcggcacagaacaggagagaaagcggcaggaggaagaagaggtggataagatgatggaacagaagatgaaggaagaacaggagagaaggaagaaaaaggagatggaagagagaatgtcattagaggagaccaaggaacaacagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84426 - DNA, 1357 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaaggtaagaatggtaatagaatttacctgtcagaatccctacactagggatccggaaaagcaggattaggtaggacaggtggcccacatcatctggtttttccttcctctttgggggtggttatcagtagggtattaagtggaagggagagtatgcccagtgacaaagccctcttttcatcaccaccaccagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84427 - DNA, 1141 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcagctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84428 - DNA, 934 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcgtggataacagggccgagctgatt

SEQ ID NO: 84429 - DNA, 1266 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagaggtgagtaataggagggatggggcttggccttcctcaaggtcaaaggaggaatgccattcagtaaaagattttaatggctctgtcttttcctttctcagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84430 - DNA, 1256 bp, Homo sapiens
ttaatcggcacgaggaaggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctgacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtgataacatcccatgcaggagctctagctctcaggtcctcccctccctgtttcattctcatctcacatgcccctcttccccacctaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 84431 - DNA, 897 bp, Homo sapiens
cggagacgcgccaagcaaagccgttacacggactgtgcacgcgcctccggtgtccctgcgcgtgacacaaatttggccccgagggagctccatgtgcctgagtcccaggagccctagatgccagcgacagcttgtcaccaggcctgcgacgccaatgggcgggagtcggcggagctcaggacactgacgacgggcctgggggaaagcggtccccacacagcccggggccagaggagcgggctgccagggtcagacggaggaagaccgcgggaaacagactggacgtgcagggaaaggtccagtcccacccgcgggtgcagggaacagcctgtggggaggggacccagggccgcgtgggaagagtcagggagcttaggtggaccgcccggcaggaagagaggggaaggctgagcagtgaaggggtccccaagtcagccaaggcagagttcccaggtacgaattcagagcctgacggtactgggcggggaggtagcccccaccttcctgaagccccttccttacctctgggagcgtgaggctggagacgcctgggtaggtctgagggtgagccctgggtgtggggtagctccaccctgcaagtgcctagaggccccacacctccagcctccctctgaattcagggttctctgtcctgaggctgcccaggggagcctggctggggcgagatgggccggacatgggcctgggcgagtctcgccacagaggggcgccgctgagcagccaggcctcctgaggagtggacactctcccggcaggccctgggatccgccacccacaagcacacttggaggcagcatccttgcaggactcgcgccggagcctgagccctccagccagcccagcgcgccaccgcccttctgtccccagccacccacg

SEQ ID NO: 84432 - DNA, 844 bp, Homo sapiens
cgccccaaccacccctgagagccattaggtgacagttgtgcttcacccgcaaaaggtcttcctttgccaatttttgtcacaagtttttgcatattgtttgcataaatttgcaggtaggattcaaaaggtcctgattccaattacacaagagaaaacacactgactgcaagtgcagttgaagaaggttctcagaagggcacgctggaaccgctccccggtgccaggagaggtgtttgaactacgtgctgctggggcgcccagacgggcttccccacgatccaggaaatcagagcttttgcaacgttggcttgaaatcgtggctaacaagacagaaaagtgctcttctcaaccccaggggaagactggggaggtgggcggggccccagggcccactgattccatccaagagggggcatggaaggacagcggcgagcccacgtctggagcttctccctcctgtgaaaggcaaacagaatcctgagatgccaaactcactgttccaaagggaaagggaaagcttggaaatggcgtcacgcaaaacctgcctctcaggagaaccagtctgtttctgaacagagagcttgcaagacggccggccatgtatctccccgggaggcctcccacactctgacagtgtcgatgagcagctgatcctcgcgagtgtgggacaaaagactagggcttgcttttatttttgttcagggacacagagccaacaccaccagctactaaaggaataaaaccacatcttgcttgtttaaagcagtaaaggaacaaaattgcataggccaggaggtgcttttgtgtctccagccgtgacttctggttaaacactcgagaaaaa

SEQ ID NO: 84433 - DNA, 452 bp, Homo sapiens
tgtggctgaacaataagcggaacagttttctttgactgtaccacccctcccccaagctgggacagtggcacacacagagaatttccctagacccatggtttctacagggggaaaagtgaattggaggaggatattccatttcctcgccattttgggtccctttgtgggagggagatatgtgaaggacatgaaaaagttcttgtgtggctattttagaaagtacttgagataggttttatctcagacatccacacacgacctctctctctatgtgctttgctggctgcaatttgtttgggattgagaagagtaatttcatcttggtatctgcaacttttatactacaaagtaaaaacctatagtagttgcacaaagtataaaaagaaaggattcaaaacatacaaccacagaaaaccagaaaaaccacaaaggaagacagtacagaggaagaa

SEQ ID NO: 84434 - DNA, 440 bp, Homo sapiens
gccttgaaattttccaactcagtgaatcctatagccacctagcacttgtcttatagcacttgtgttgtgttagggacaatattattaatggtgtttacatacaccagtaaaagactaagctcattctggatcgggattagttttaattatttttgtatcttccagtcttactgtatgcctgacacatatattaaaaatcaaataatattagcctggattcataaggggtatttttgccctctcaattaaagaatagctaagaactaaactctgtagtattgagtgtaagtccagcagaagctcagaggtaggaaggatccattggggctagagtaattgggaagctttgatgataagagcttgatgaaggaaggcgtgtgaacacctgggctgcataccaggagcaaaggcccaggggctggtaagtgagtgcattttgg

SEQ ID NO: 84435 - DNA, 636 bp, Homo sapiens
aagctgacaccaggagcaaggttgagaggaagctgtgaccccagcaggactttatgttcccaccatcccggatgtgagaatgaggaaaaaaggagatgagctgtctccccacaagcccagagatttgaccgaggagagtagaggcctcgagctctcacctaagagaaaagacatggggctccctggggtccacagctcactgcgctctccctcctgagactcctgctgccagagcacctttccccagggtcatggatgctgaagggaacacaacttagagaccactccaccatccacccagcaagcacagctaccaagacccaaagctgaggcttaccaacgcccagggtgggagggggttccatccctgaataactccatggttcccctatgcgtctgaccatcccagccagaaatacataaatcatctcagctacaaaaaaacaaacaaagacaaaaaaacaaaaagaggaggcacccacccaaaaccaagaccacaaaacgggaacaccaaacacaaaacaagaggcgggggccgtcccacgaacaccaacgggcacgacagcacgaggagatcgcagaccaccaccaccgcctcgcgcaccaagcgctcccccactggcaccaccgaccaac

SEQ ID NO: 84436 - DNA, 3263 bp, Homo sapiens
tgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcaaaaaaaaaatgtgttcttgttctgccatttttaaatcaaggtttctgttaacgaggcattccattttccattaataaagtttaccattcgc

SEQ ID NO: 84437 - DNA, 824 bp, Homo sapiens
tggttgtgcttcctgttaggccttggggtgatgcctaagaatctccctctcgtgccaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcagcgaagcagacggaactggacgcggaccggtcgtgatgcgatacactcgacacggcagagcccgtccattagcgtgacaaccacaacgcaggttccaacgagagaagctccaagagctccaggaatcgcaaagtcagaacagcaacagcacacagagacgacaatcctggtcgccccgcctcccactccccgcaacccacagggcagagagaagcgccagcaggccagccgggaaccgggagactccgccgacaccggacacgggccgccgg

SEQ ID NO: 84438 - DNA, 574 bp, Homo sapiens
tctgacccatttccccattcattggctccttcagtcggaatgtcagagcggggagaacaggaaagggaggctgagaggccacactcttaattctgctggagtttggggtggagttggtgtgaattttgatgagtcccacgcattgggtcagaccaaagatgagggatcattggaggcctctgtttgtccctgttcccctaactgagagctccccgaggaattttagttcagtgagatctttattcctacctctttaggatccaacttcgtttctgcccccggggaaaagcctttcgatttgagctagctttttccttttttcccaggccagttatagtttttatgtgatgggatggaaaaagtatcccagtcgcgaaacttgcctgacctgcagaaatgtgtagtcgtgcctggtgctgtttgaacgggatcttttccttttgcaggcgggagggttcgaggccaatgatgggagaccaccgggatgggcaggtgagtagagccccgatgccaagccctggggccactgtactgctgtgcaggcatagcggaccatttctagccaggcggccgc

SEQ ID NO: 84439 - DNA, 424 bp, Homo sapiens
  misc_feature (20)..(20): n is a, c, g, or t
tcgagctcgcgtactgtganagcacacccatttcagactaattttctggtaggtattcagttttagcacataatcatatttttagttttgttctctttcgtttttttcctgtatgagtaacattaacttttgtctctagctcttttaaggaagaaaaagatataaagccaatcattaaagatgaaaaaggtatgatttaatttaacgtggtagggagccaggtatggttcccttattttgggaggaggggcctggagatatacacactttggattcagtaatttgttttgttatgggttaccggaatcaaccacctaatggtttcttgagagactagttttagaagttcgcaagcacctgcattttatgtttctcttgtggttgtcatctatgggatggtgaaaagcacattacaagaaaggaa

SEQ ID NO: 84440 - DNA, 2936 bp, Homo sapiens
gtacccacctcctaccccacgattgaatggtgattgcattcggttcagcaccttggacattggaaaatcagtcagaagacccagacttgaacaaaaactcgaagaagactattgagaaccagccgcgtggttgtaggtgtttaaatctgtgggggccttttctcttccgtgtagcgtagaggcttacctagaggcggtcgcggcgcaggtagtgtaaccagtataactttgtgtacccgcgggttttccaatctctgtgtagctagcagttctcttcgtgttagtgtggcagccgtgccagttccacatttgtgattgctttatttccctggtaattaaaccttgtgccattctattcctgttaaatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcaaaaaaaaaatgtgttcttgttctgccatttttaaatcaaggtttctgttaacgaggcattccattttccattaataaagtttaccattcgc

SEQ ID NO: 84441 - DNA, 2752 bp, Homo sapiens
tgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcaaaaaaaaaatgtgttcttgttctgccatttttaaatcaaggtttctgttaacgaggcattccattttccattaataaagtttaccattcgc

SEQ ID NO: 84442 - DNA, 2032 bp, Homo sapiens
ataactgacatgggcatgattattccttgagtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcaaaaaaaaaatgtgttcttgttctgccatttttaaatcaaggtttctgttaacgaggcattccattttccattaataaagtttaccattcgc

SEQ ID NO: 84443 - DNA, 2060 bp, Homo sapiens
tggttgtgcttcctgttaggccttggggtgatgcctaagaatctccctctcgtgccaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcaaaaaaaaaatgtgttcttgttctgccatttttaaatcaaggtttctgttaacgaggcattccattttccattaataaagtttaccattcgc

SEQ ID NO: 84444 - DNA, 2049 bp, Homo sapiens
  misc_feature (1253)..(1254): n is a, c, g, or t
tgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcgtgatacagaaaaggctttccaanngaggaaagagggtcgcaggagttgtggtagaaatttactgggttagtggactctcttcctacagagccagagactactagtatttgaaggaatcttagtgcaggcaaagtagtgggaaggtggtgggccgccgcatagggttgtgaccacagatgtccgggagtcctgacagctcgctgttctggcttcgtccatggatgtccgacagacacgtacagataggccgacttaacatgccttaaccagctggcatcaacagggaggtccatgggacaatgcatgactctgcgtggagaaatgcccataggatgaacctggtgggacctgagaaccctgctgaaaaggagaagaacagtgagcgcggaagacaggagaagtcgaccacacttgggacgatctgcattatcttacgagggtgtgcctacacgcgtgccgagaccaagaccgaaggctcagatacgggggacaaccgaacgcgggacgacaacgctgcggaccacaaagagcggaaaggcggccacctcaggccggagcaacgcgcacaaaacacgaaccgggggccccgcgaagcgcacggatacagcaccggggcaccaccgggaagccatctggagcagcgcccgccccgagcaggacggcaagccccacaagacgccggaggacatgcggcaaggctcagccagaagccaccaagagccaaagaaaaaaccaccgcagcaacgagacagagcccacaacccgcccaacagctccacacccccagatacagcaaacacgagcaaaacagcaacgcac

SEQ ID NO: 84445 - DNA, 1072 bp, Homo sapiens
cgctgtcctcaccggaggctgtgtagcatcttcctgaacttgagttattctgggaaacttgatggctgccacttgctgaaggacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcaaaaaaaaaatgtgttcttgttctgccatttttaaatcaaggtttctgttaacgaggcattccattttccattaataaagtttaccattcgc

SEQ ID NO: 84446 - DNA, 1295 bp, Homo sapiens
tctgacccatttccccattcattggctccttcagtcggaatgtcagagcggggagaacaggaaagggaggctgagaggccacactcttaattctgctggagtttggggtggagttggtgtgaattttgatgagtcccacgcattgggtcagaccaaagatgagggatcattggaggcctctgtttgtccctgttcccctaactgagagctccccgaggaattttagttcagtgagatctttattcctacctctttaggatccaacttcgtttctgcccccggggaaaagcctttcgatttgagctagctttttccttttttcccaggccagttatagtttttatgtgatgggatggaaaaagtatcccagtcgcgaaacttgcctgacctgcagaaatgtgtagtcgtgcctggtgctgtttgaacgggatcttttccttttgcaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcaaaaaaaaaatgtgttcttgttctgccatttttaaatcaaggtttctgttaacgaggcattccattttccattaataaagtttaccattcgc

SEQ ID NO: 84447 - DNA, 1407 bp, Homo sapiens
tgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgaggttgttttttctcagttttagaccagacgctatctccttttcattggtcatgtaatgacacacataagctgtttttttctgcaattggccagccagactgacgaaattgtagttttgcttctaaagaatgtttcgtttctctttgtgtgtttttaatgggtgattcaattccttttctttttctcaacctaccatg

SEQ ID NO: 84448 - DNA, 786 bp, Homo sapiens
cccacagcaggcaggcactcgtgcagatgggtctggctgctttcctgcacggccactgtgactgcttggccacttgggactcaggacactggactcggattttcatctcccagagggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcaaaaaaaaaatgtgttcttgttctgccatttttaaatcaaggtttctgttaacgaggcattccattttccattaataaagtttaccattcgc

SEQ ID NO: 84449 - DNA, 2316 bp, Homo sapiens
tgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccaggtactgataagagaaacacgacagttatggtttgaaagttttcacactattattttaaagctgtctatattttaagctgtgttatgatcttgtaaattgctctaatggtggacaatccagatcatacaaggatcagagattggaaacccattcgtatcaccagatctgtggaagagccattctggcttcttgaggtcaaatacatttggtgcaatgtagtagtgattcttttcatgtctaaccacgtagagtggcatttaattcccccgtccccgtgattcctccatgtgtttctacacatgaaacagatcttgtgatattttgctgcagtcattttgattaacgcagttaaggcaggataaagctgttgtcagggcacttaccacctgagaagtgactggattccagaagaggaaacagagtttctccgtgaaaattttcaacatattattccccttccggactgcgtttatctcccaccgtcagaagagattctgattttcatattggattgttctgttaaaagaaattcaaagaaatttggaagttgagctgtcattgaatggtgattgcattcggttcagcaccttggacattggaaaatcagtcagaagacccagacttgaacaaaaactcgaagaagactattgagaaccagccgcgtggttgtaggtgtttaaatctgtgggggccttttctcttccgtgtagcgtagaggcttacctagaggcggtcgcggcgcaggtagtgtaaccagtataactttgtgtacccgcgggttttccaatctctgtgtagctagcagttctcttcgtgttagtgtggcagccgtgccagttccacatttgtgattgctttatttccctggtaattaaaccttgtgccattctattcctgttaaatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgaggttgttttttctcagttttagaccagacgctatctccttttcattggtcatgtaatgacacacataagctgtttttttctgcaattggccagccagactgacgaaattgtagttttgcttctaaagaatgtttcgtttctctttgtgtgtttttaatgggtgattcaattccttttctttttctcaacctaccatg

SEQ ID NO: 84450 - DNA, 1367 bp, Homo sapiens
  misc_feature (1367)..(1367): n is a, c, g, or t
tgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagaaaaaaaaaaaaaaaaaaaaaaaaaaaacacgtggggggcacggccagggcccccgaaaaaagctctagaaaacacaccaggaggagacgaaggagcccaaagaggagaaaggaacaagggacaacacgtgtaccaagaagaaaccggggaaaagaaaagggcaagaaactcaccaacagataaaaaaaaaccgcgggggaaaaacacgagaaggtcagagaaagatccaagagagagaccaaagaagagcaaacaggagaacccaaaaaggaggaccagaaagaccgaatcaaatacccgggcagggaagagn

SEQ ID NO: 84451 - DNA, 303 bp, Homo sapiens
gatcagctggctgggttggatgttatgaaaacaaagcaaaaagcagctctttgcaatttatgcaaataacgctcttgagttacctggaatacaatgtgcgatgatgatttttctcacctggaaaaaaaacccaagcgctctaaaggctgcgggaccgttactgaacccatgttacgatgaaaacgctgagcacttcaaggggaaaaaaattgtctgactttgttcctaggcgaggcggctttgcacaaggtggacattcccagggccacgtggtgccaggtggcggactggaaggtggcggag

SEQ ID NO: 84452 - DNA, 302 bp, Homo sapiens
atccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcagtcttgcgtgcgcgtgcaca

SEQ ID NO: 84453 - DNA, 3118 bp, Homo sapiens
tgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatca

SEQ ID NO: 84454 - DNA, 2542 bp, Homo sapiens
tgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcaggtgagtagagccccgatgccaagccctggggccactgtactgctgtgcaggcatagcggaccatttctagccaggcggccgc

SEQ ID NO: 84455 - DNA, 4172 bp, Homo sapiens
tgttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccaggtactgataagagaaacacgacagttatggtttgaaagttttcacactattattttaaagctgtctatattttaagctgtgttatgatcttgtaaattgctctaatggtggacaatccagatcatacaaggatcagagattggaaacccattcgtatcaccagatctgtggaagagccattctggcttcttgaggtcaaatacatttggtgcaatgtagtagtgattcttttcatgtctaaccacgtagagtggcatttaattcccccgtccccgtgattcctccatgtgtttctacacatgaaacagatcttgtgatattttgctgcagtcattttgattaacgcagttaaggcaggataaagctgttgtcagggcacttaccacctgagaagtgactggattccagaagaggaaacagagtttctccgtgaaaattttcaacatattattccccttccggactgcgtttatctcccaccgtcagaagagattctgattttcatattggattgttctgttaaaagaaattcaaagaaatttggaagttgagctgtcattgaatggtgattgcattcggttcagcaccttggacattggaaaatcagtcagaagacccagacttgaacaaaaactcgaagaagactattgagaaccagccgcgtggttgtaggtgtttaaatctgtgggggccttttctcttccgtgtagcgtagaggcttacctagaggcggtcgcggcgcaggtagtgtaaccagtataactttgtgtacccgcgggttttccaatctctgtgtagctagcagttctcttcgtgttagtgtggcagccgtgccagttccacatttgtgattgctttatttccctggtaattaaaccttgtgccattctattcctgttaaatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcaaaaaaaaaatgtgttcttgttctgccatttttaaatcaaggtttctgttaacgaggcattccattttccattaataaagtttaccattcgc

SEQ ID NO: 84456 - DNA, 151 bp, Homo sapiens
atgacatatacattgtatggctgatgactttgtgcatttctaatttattccatgaccccacttgtttaatttgtttggattaactatatgctatttgtttgtactgagattttgttttatttttttaattacaggttatttgtaaaagact

SEQ ID NO: 84457 - DNA, 671 bp, Homo sapiens
atttgagcagacttgaagaggagagaaactgagacacgcagggcttgtggtccctgacaaggaggaccctgagggcaaccacaccttgccatgcagagcacctggcttctcatctgccaagctcactctgacccggctgcaggaagggaaggagccaaccccggactcaagactcaaggggaccagaaccagggagatgagacataccagggctgggcagctgtgggggtccttccagagaggagctgagatacgcctacctggaggggcccctgggcctggaggggctcctcagtgtgactgggtgaagtgttttcagaggaccagggttgaggttgggggcatctcatccagaccctgccggcatctgccccagaacccaagggcccctccttcctccctcctcaatggaaatgctggagatgtcctcagtcaccctctgagcactcacacatcaccccttatttggaaatttttctcactctaaccttccttcctgccgcaccttctgccccatccccaggctctggcctctctctctcctcttctaccctttagcaggtaatgactcagttcccactgaggagccagctgtaggtgagagtttgggctctcggtgaggttgggagaaggaaaaggcttatgggccagggggtgggagggagaatggg

SEQ ID NO: 84458 - DNA, 234 bp, Homo sapiens
ccaaaaccaccaacctctcatcttctaagtgactccatcaccaccggccaccgggacctgcggcctcattgctccagcccgccccactcgaccgtcagactcgctcatcgaactctttttgattaaccctttctgtgttcatcccacggaaaactgtgtgtccggcaggggggaggggggaggctaggggcagttgctacctttcctccatctcctcccaccacccatgcctcc

SEQ ID NO: 84459 - DNA, 429 bp, Homo sapiens
ggtgagccagatacagtggctcacacctgttattagcaacactttggaaggccaaggcaggaggaggaggatcgggtgagcccagaagttcaagaccagcctgggcaacagagcaagattctgtctctaagaaaaggaaaaagaaaatgaatagatagtggtattagatgttaatgacatcagttgtttttattctttattctttcttagaaacagattagttttctcgaattaaagaactaccatttttcttttttctacaactttcaagagctggtgaagaaatgatgtttagatttaatagatatagtagcagtcatatattaatagaatagaaactgagactctaggaaaaagatagacatgagataaggagtaggcatggtagacatttctagattatttatgaaaatgttgtagaattcattt

SEQ ID NO: 84460 - DNA, 431 bp, Homo sapiens
agcgggggtttttcatcggggagtgggagtggactgaaggcttggccgctccgcctcactgagccggctcagccagcgcagctgttcctggaacgccagtcccttaggatgggagagagcggagaaggcaaagaggaacagactgggaaagagactggatagattctaatatggtgaaaacatcagaagcagttcagggactaggaagtgggaactctagagatgacagacattctgctgggtggtttttaaagtttcttccagagtcatctgcctcattaacaacaatttttgtggaagaagtctgtctttgattttatgaactcacgtgactccttggtctgttacgaatgcacaatgctccagtccttcaataagcccattacatactttcaccatgtcatctataggtgctttttctccagtgtaaa

SEQ ID NO: 84461 - DNA, 766 bp, Homo sapiens
agcgggggtttttcatcggggagtgggagtggactgaaggcttggccgctccgcctcactgagccggctcagccagcgcagctgttcctggaacgccagtcccttaggatgggagagagcggagaaggcaaagaggaacagactgggaaagagactggatagattctaatatggctacatcctggtgggaggcaggacactgaagtacttagaacccctcagaatggccagatcctgctcatgcttgggctagaagaatggaacctttgtaattctggacttgtaaatggaaacacatcacttactgtgaaccacatcccagacagacatgggcaggtgaaaacaaattcttccagatggcctgacagcacctgtctacagtacagtattgaggcacacaggaccttggaaataaaagggaatattacaaatactgcagagacacaaggattagttgttgtttgtttaagggagaaacatccagaagaaacaattagtaatatttctttactgcttgagtacattttatcatcagatggccaatcatataactgggtttattcaagaaatttttttctgtaaaatataaagtgaatcacctatctaattttgataacagaaagcccagggagcagcagcttaaaccataagagcatatactgtttacctgaagagagagaaggtggttccaaagtgctctccaaagccccatgatgtcaggacatgggtcagcatctctacagctctcctgcttctctctcatggg

SEQ ID NO: 84462 - DNA, 254 bp, Homo sapiens
tgagctggttctcatctagaccaaagtcataagataaagataaagatgcatttacagatttcgagaaagcatacatcagggaaaataaaaaattaacctggcctatctatccagttacctgggtcaaaacctcatttttttttaatttgaaaagtttagtacaaaaaaaagtttaagacatggagagcctgattctccatatagattccctgtcttccagtggcagtagatatttggaggtataaaagtgaaaa

SEQ ID NO: 84463 - DNA, 709 bp, Homo sapiens
attattttacagatgaggaaaatgaggaccagatactaccccactcactatagtagctaaaagttttaaaaatagtgacaacatcaagtgttgacaaagataaggagcagctggaagtctcatacactgctggtaggagttcagccactttggaaaagaattcagcagtttcttataaagttaaacatacacttgccaagtgattcaacaatcctactcctagatattgaccttgatggtcacccaaaaacctctgctttattcatcatcacccataactgctgctttattcataatcacccataactggaacaacccaaatgtccttccacagatgtgtggatgcacaaaccatggcccatccactcaatggaacactactctgcaataaaatccgtggcagtatgggataatttcaaaggaatcctgctgagtgaaagcagctagcctcaaaagattacatgctgtataattccaattcgatgacattctggaaaaggcaaaactgtagtgatggagaacagatctgtgcttgcagatctgtttatagtcacatcagagatgtgactatcaacagcatcagggtgttctttaggatggtggaactgttcagcatcctgactatggtggtggttacataaatgtacacatgtattagaattcatagaactgtatgacaacgacaaaaagtcagtacaaacaatgagga

SEQ ID NO: 84464 - DNA, 552 bp, Homo sapiens
ctgtctctgcagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggaga

SEQ ID NO: 84465 - DNA, 865 bp, Homo sapiens
ctagggactagggaggctgaggcaggagaaccacttgaacccaggaggcggaggtggcagtgagctgagatcatgcccaggcactccagcctgggcaacagagtgagattctgtctaaaaaataataattatcgaatgggtaatgcttgtgactctgcagcctggctttcagagcaattaacaagagctgggggtcaggatcagtatgtcatattaaacaaggaaaaaacagaaccaaaactttttttttttttaagaacagggttggtggagattgggatttataataaatgactgtgttcttcctaaaaaaaaagaataacaaaacacaaaaaataaacaaaaacaaaagaaaacaacacacaatcaaaaaagataccacaaaaagcccaccacatttaccactacacacaattttcccgtcccacagcgcaccactattatgaccctccccttacacacctccgcacgtacacccctttcatcaacacaatcatcaaaaatattgcaaaaaccctctacaaactgtgaaacacccattgaaacaacacccctactaacccctaaagacacaacatactacgacacaacacaccacacacaaactcttccaccccactaacactccactctcaacccttccaaaccacgtccaaatcgctatacaaccaaaccctactacacatctcaccccttcacacaaaattactcccacccacccccacacaacccccccaccctcatcaatcacacatcagcataccacctccatcatcatcaccccccatcccacccacacatactccaacatccacccgaccaccccaccaccaatcagtcaccaataccaccaacacccgacacc

SEQ ID NO: 84466 - DNA, 205 bp, Homo sapiens
gcaaagcattttactacataaacgttttagcccctataaaaacatccggagatccttttgttgttcatgagcatgacaattgggtgttttcatgcagcgagtgagatgtgccaccctggaaccttgttacgacgtcgcatgttacctgtctgacctgaaaaataattaataagtaaaacatacggaagccagtttctcatggcta

SEQ ID NO: 84467 - DNA, 780 bp, Homo sapiens
caggctccaggccctggcttagagggagcggggagtctggacttcaggctggatcccttcctcttcctggagcgggtgctggcccccaacccgcttgcgtcagggacaaaaggactccttccctttccagcctggaaagcccctctgctgcaggctggaggaagggaccttgggcccagcctatagtcagcggtgtctatgggcatggatctggacggggaaaaggacaaagcagcctccatccacagttcattccgggaccaggcccttgcaggcacgcgctgggctcctgtgggaagacagtaagggccccaggacagacctcctctccgggcatctgggttcctagatggcagaggtggcagagtggggtgggatggcccaattgggagctttagcttccggcaaagagctgagcacagtacatcttcaatgtgtaagattctcctgggagaccagggcccagctggtggtgagctgggggaagtgggtgatactgccgtgggaggagccacctggccctctggggaagtgcactcgctgtctgcagcgcccaggcctgggtagctgggtgggggctggggggccatctgtgctcagggtgcctgcacctgggccttctctgccctgggccaagcctgcccgagcctctctgtcctctgcctgcccagctggacatctctgggcctctctggagaccagtggggtgggctgtgggggcgtcatattgccctggcttggcatccctcttgtggctgtacccctcccagcagccccagg

SEQ ID NO: 84468 - DNA, 370 bp, Homo sapiens
tgcttgagcccaggagttggaggctgcagtgagctatgatcatgtcactgcactccaacctgggtgacagagggagaccttgtctctaacaacaaaaaacaccagttttctctccagtagggtcttaatattttcacttcttccataaaactgcctacaatcttctttaagttgcctttatggttaataaatgtaaaatgttgatattttcagtgaactcctctgtagactacaatatttttaattgggcaattagtctctctacagttgctgatgtaccggaaaacctcagagaaaattctactaaatgaaagatactttcaataccattttttgtactgaaatgtattaataacttaatattttcttt

SEQ ID NO: 84469 - DNA, 370 bp, Homo sapiens
tattttggcaggtagaaggacttcttgtttgtatagaagtacacttggctttattaaagtataggaaaattcactaatatccatttactgtactatattttattagtaaaagaaagattttaaaatcaaagaggtagtcatatacattggtaattcttaatattctttactcaggtaatttgtcattatttatttagacatgaaaatactatgagcctctataaccttaagttccagtgcaaattattattttgttctgttttttttttccaccaacaatctttgcattgtgctagcacacaattctcacagtttaataaaggagcttcttttgtattttaagagctgtgcagagcaagtactgtatatc

SEQ ID NO: 84470 - DNA, 503 bp, Homo sapiens
aaactagaacattaccttctctccaggtctccagttctatcaccctaattctagaacatcagctcctccctgagtctccaactgaaagaccctcaatgcaacaacatcagctcctccccaagtcttcagctgcaagaccctcaaactagaacatcagctcctccccgggtctgcactgcacgaccctcaatctagaacatcagctcctccccgggtcttcagctgcatgaccctcaaactagaacatcagctcctctccaggtctgcagctgcacgaccctcaatctagaacatcagctcctccccgggtcttcagctgcacgaccctcaaactagaacatcagctcctctccaggtctgcagctgcacgaccctcaatctagaacatcagctcctccccgggtcttcagctgcatgaccctcaaactagaacatcagctcctctccaggtctgcagctgcacgaccctcaatctagaacatcagctcctctccgggtctgca

SEQ ID NO: 84471 - DNA, 906 bp, Homo sapiens
cggaaaggcgcctgggctggtgacggtgtcaagtgtaggcaagaaatacggctgatcaagaagcgacttcacctccctcgcacaacactgagtccctttgcggcaggggccctccccgccgcgaaccctacttggaaccttgcgccatgcgatgtctctctcattctaggccacggaagccctgggtcaccctttcagcctggttctctccggtggtgctggcttgtttctcctgtctgttggggtcagctgcgtccagcctcggctcctgcaggattgcccgggcaacccagaggagatgggcgggcgtggaggtcctccctggatgacccttcccaccatttcaacatcattaggaatttaacaggcttttgcaagaaggcccagtctccctgcttcctggcctttctatttaaaagcacccatcttcaccttctcccaaaggctctggaagttttacagacagcatctttctagcctcgccctgcgtctctttctagtcatttgactgaggctgaacaaagcccagatgggagtttcattcccttcacctcccccaactcccagctgaaggaggctggccccagacacaggacacagcttcctgaccctgcgggcaggagcctggcttgttggtgacgggcaggagcctggcttgttggtgagtgggcctcctcattgctgctggagttttccatcctcattccacaacaagccaagtcagcaagttgctgccaggaaccttcacaccttgtgctttgggatctgaggggaaacacacacaccggcaccaccctccctgagcccgggaatgaagccagcatcagcggagagcaacctactgaggaaaatgatggagtaattccctgggcacacttcaggcgtggtgccaggtaacaggccctg

SEQ ID NO: 84472 - DNA, 579 bp, Homo sapiens
cccaccgtggagcagaccactcagacccaccggagacccagagttacacactgctgtgtccgtgtgtgcgcgcctgtgtccgtgtgtgcttgggtgtgtcgtgtcattgtgagtgtgctggtgtgtgtgcaccagtgggagtaggggagtgtatattagtgcatgtgtgagtttcagtgtgtatgtgttagtgtgttacgggaaaggggtcctgatccagaccccaagagagggttcttggatctcgcgcaagaaataattcaggatgagtccacagtgaaaagcaaaagcaagtttattaagaaagtacaagggattgggcgcggtggctcgcacctgtaatcccagcactctaggaggccgaggagggcagatcaactgaggtcaggagtttgagaccagcctggccaacatatagtgaaaccctgtctctactaaaaatacaaaaaaaaaaaaaaaaaaaaattagctgggtgtagtggcatatgcttgtagtctcagctacttgggaagctgaggcaggagaatcgcttgaacctgggaggcggaggttgcagtgagctgagatcacgctactcc

SEQ ID NO: 84473 - DNA, 599 bp, Homo sapiens
gagggattgaaggcggtggtcgctaagctaggtctaagacggacagccagggcgacaaccagtctctcgctacgtgtccccagcttccctgtttccgagcgcctctcaaggcgcacgctctggacttgttcagatgggggaagggaactggtctggaactccccactattcccgaggttcccacgcctccagatccggagaggccgtttcgctccagtggcctggcccccctgccccctcagcctagccgttcttgatcgtaagtgctaaaaggaacaaagaaggagaattcaagaatccacacataagcccaaaccctgacaggagccttttcctctcccatctcctgcctacgcttcctcctagtagctttttaactgctggcggttaagttactttgactggtttgaattaaacgcaaaataggtttaggctgagaaatgggccagacccttggcgatctgagaaagaaagactgagtccggatgtcaagaggcctgggcctcacgagggagtttgtctgcttatttgaacacctcagagttgaagatcttgttactgctatttctgtgctggtgaatcagtacagaccttgatgc

SEQ ID NO: 84474 - DNA, 108 bp, Homo sapiens
cctccgaacccaattgctcaagcagcttccttccccaacgccagcgccagttcctctcccgttggggcccgggaagggcagctaacgctggacactgggacggccgcg

SEQ ID NO: 84475 - DNA, 369 bp, Homo sapiens
ggtagtaaagcatcccttccctcaacaccatgggtgtacaaaccagattcaatcttgttttctaacaccaccatttattgaggcctaaacagaaatatgagcccgtaggagccacctcttgcattgtctcttcaccatctacaaaattgaaaccaaactccccaacatggcatggaaaactctgcatgaactttttacatctccattataatttgtagcaggtctccaagtgcctgctttgccttcttgaatctgatgctctcgttctgtggtcctcaaattgggtgcagtggttccatgcattaaaatcactgggggagctttaaaaatggagatgcccaggctatatcccaaacctcttaaatggga

SEQ ID NO: 84476 - DNA, 885 bp, Homo sapiens
ggtcaaaaaaaggttcagaggaaaaagaacagatttgcgaccgggcacgttggctcatgcctgtaatcccagcactttgggaggccgaggtgggtggatcacctgaggtcaggagttcgagaccagcctgaccaacatggagaaaccccgtctctactaaaaatacaaaaaaaattagccaggcgtggtggcgcatgcctgtaatcccagctactcgggaggctgaggcaggagaattgcttgaacctgggaggtggaggttgtggtaccagcctgggcaacaagagcaaaacttcatctcaaaaacacaaacaaacaaacaaaaaagaacagatttgcttttttcttaataaagaaaaatgttttgaattcactctgtagaaatttaaaactgcttgatgttttagtgatcaaaataaaattatcaaagctaaaaataccaaatagatatgtcactaaattgaaaaaacacacaaccacaacaaaacaaaaaaaacaaaaaaaaaacaaaaaaaaaaaaaaaaaacaaaaaaaaaaacaaaaaaaaaaaaacaaacagaaaaaacacaaaaaccaggacaacaacaacaacacgctaaccaaaagcaaagaaaagagcgggggcgcccactgtaacaaacacgcggacagcaggcagacagcagaacgcggacacacaccactaaagacactgtagtcaagggaggcgggggggcacccaagagacgaggcagggcaaagacaaggaaggcgagggggggatgccgactgacggagaaacgacaagagcaggagagccagaccgcccaccgagcggaggtgaggcgcggagggcgagaacaaaaattgcgggaggaggagcgaaactggggggggaaagaagag

SEQ ID NO: 84477 - DNA, 275 bp, Homo sapiens
tatggtgaaaagatatatatatatttagaattaggcagctggactcagtttagatgatcccaattttgttggcaacatccaaagcatcataatcaggagccagtcgaacatataccttcttctctccatcaggccgaatcagggtgttgcccttggccacatcattgtcatagagcttcttcacagcctgtttaatctggtgcttgttgactttaacatccacaatgaacacaagtgtgttgttgtcttccatcttcttcatggcgactcagtgg

SEQ ID NO: 84478 - DNA, 640 bp, Homo sapiens
gcacccggccgctagaatttttgaagtatttgcaactatgtactttttgaaggaaaaaaaccttcattctcatgtcgctatgtagaatattcttcatcattaagcagcaccataactatcatctagtgattagaattttatttttccataaaaatatgaggcactgtttttgttttggacaaaactacacatttttctttaaagatttacaaactcctatgtaatttgaaagttgctatactgggagtaatctgaaaagcttagaaagttcatttccttttatatttccatcttaaatgtgctgctttttctattcgaagtttacaaagaaacaagtaaatgggatgtcgtgcatgtatgcacatgctcacacgtgtataaatcagtgtccatttaaaaaatattaacatttaggtaaatagagtattacatattatactctttagatgatcaagactctaatctgtgttgacacttcagaatttattaaaagatcttcccttacttttcagtaatttaattagtttctttaagcctgacataacgaggaggagcccaaacaacataatcaagttttaccttgggaggaaaaaaagttttacctgctagaaagaattaataaaatattgctatacattca

SEQ ID NO: 84479 - DNA, 727 bp, Homo sapiens
cattttagctttgccatccgcggacggcttgagtgttaaccagctcggtggaccgtttgcgtttctgcgagggcagcggcttcctctagaataaagaatgaagaaaattgaaatgatctctgaaactcgagaatagttatgtaaaagagaaaaaacaaagtctatcgttcaaaggctactgaaccaggaaacaggcagcccgcgttaaaatcccagctctgggatcaactggttagattattttcattcaggcatcttttctttctgcactacttcatctaccagttgctaacattgaatgaacctttacagtgttccaggtactgttttaagagattttctatactcatataacatttttgaaagaaaaagtgaaatataggcctacatgttcagcctcaacgtgaacgtgatgaggatgaagacctttatgataatccactttcacttagtgaatcgggattggactgctgcattctaaaaataatggtgagaagaatgaataaattagagtttactatgtaataaaaccttctaaaaaagaggagaggtagcagaatttacaagaaggttaaacctgaccttactgaagagaatgataccctcatagcagcgcatcttctttgctcacagaaagctccttggacaaatgtgtctcgagtttcaagtgagcaaaccttcaatgtgtctgccattttggggaagaacgtgtaaccttggcagtgaa

SEQ ID NO: 84480 - DNA, 305 bp, Homo sapiens
aaacattatagccttcgggcattagcccaggagacacagttgagggtcctaggtgctttcacttaaggcagggctgttgagtcggtgaggggatgagggcatctcaaaagaaggctggctttcaggattgcacagagatgttcctgctcccagcagactggggtaaaatttcctgggaatgagggcatttctgaggaaaagagaagggaaattttgttgactacaagttgctatagtataaatgggagaattaatctatttttaaatgctcagatgtaaagatacattcttattgttgaatccat

SEQ ID NO: 84481 - DNA, 386 bp, Homo sapiens
agaagcaccaaaagactgtgatacacctaggtagtacttttttcaactctacctgtgaaagattttaagggttttttttttccccctgagggaaatttgcatttcactggagggcaaatcagctgtatttttttttttttctggttatcccactaatgagtcctgtgaccctaggcagtcagttgcttttcagggcctctctgtcttcctctggggaatgctacatgattgctaaggttctttactaaaaactcaacattctatgtctcattacctccttagcacctaaggtcaaggtgtccctagggaatggtgacaggttggtgccatgccttagtgccatgctatgtatgcacaaaaggtgctactccaaggcacctgcaagt

SEQ ID NO: 84482 - DNA, 245 bp, Homo sapiens
ttacctgcaaaattgagaaataatgggttgatgggagaattaaataaatttacatatgcaaactgtttagaaaaatgcctgagcctactctgtatgttatttattagtcgtattattttctttcctttaagacagagtttcacactttcacccaggctggagagcagtggcgcgatctaggctcagtgaaacctccatcccctgggttcgagcgattcgcctgcttcagcctccccagtaaactg

SEQ ID NO: 84483 - DNA, 534 bp, Homo sapiens
atacccactatttaatccagtaatttattgggtaaattttacccagtatctttttatttgacaattaggtctttcagtgttttactgttctcatgtaattatacgaatcttttagctttattattagcttcctaagttattagagcctatctcagaattaaatcacagtatgtaatctttatgaaaatcagatttgacatagtatttcccatattctaaatcttcagtttgaaaaaaatgtgtttgtgcatacacacacacacacacacataagtatatacatacatactttttgaaatgcaacacacttataatttgagagctttaaacatttgagtttttacagtgtttgagaaatctctagtctgttattagtgctggttgtccgatatagacactttaaagctgtgaaagcattagaggcagaagaagtgacatggaggtagttgagccaggtggaccagtgttaatcagtccagctttggagtgtttatgtagaaacatacatgtctatggcagtctatccacatttga

SEQ ID NO: 84484 - DNA, 831 bp, Homo sapiens
ccggagccgccgctttggtcacagtgaccgccaccattgcccggggatgggtccctgagacttggcgaagtaggagccctgtgtgatcgtgcgtcagagtcggggctgagaccagccctggccagggcagttaccaggacggtctccggaggccgagattcgcggagggtccaccagtaggaagaaaccccaggaggaagaaacctcagacagatcgccggggaggcagcgcgggatcccagcctcaggcgtgcgcggacggtgtgcgggtgaatctccccaaaagtggcgcccttgtgatgtcgaggacaggtctccctgtgtgcccgtgggctgctgtctcaccggtggctcgtcgtcgcggagagcagaacccggcagcttcaggggctgcctgggggtgggtgttacctgctgtatgtctgtgtgcgttatgggtgtgtgtgtgtgtgtctgtgtgtctgtgtgtgtgcgcgcgcacgcgcgtctgtgtgcccactactgtctcttacgtctctgtctctctctctctcccttctcgctctttccgtcgccctctctttctgtctctgtccgtctgtgtgtgcatgcgccttgggacacatgttccctgtgcgccggaggctgggtttcttgcacgtcggcctttcttctggtcagcctctccccgcgtctctgcctgggtgttgtggccagttggcaatcgttttcccggcggttccggtttgggggtctgtgaaggcctgggcaatgtgggcatctgtgtcggagccgcaggggttttcattccctccccacccggagcagcctctttgctagcctagatccaga

SEQ ID NO: 84485 - DNA, 169 bp, Homo sapiens
gaccaaaaaaaaaaataatattattttaatatcagataaagtgaattacacggcaaggaaaattactagaaacaaaagaaatatggccaggcacagtggctcacacctgtaatcccagcactttgggaggccgaggctggaagatcacttgaggccaggagtttgagac

SEQ ID NO: 84486 - DNA, 863 bp, Homo sapiens
gggggactgagcagcatcctgatccctgcccactagttgcccatagcacccccgcccctagtcccgacaaccagaaacgtctccagatgttgacaggtgttccctgaggagcagaaccaccccccagttgagaactgctgttttaggccaactgtatgacaagatagatttcattgtaacagatggtctctgcctaaatatttgtagattctttttttcttggtaacattgtgccattggagttacacatcaacccgaccaaattcggcacgattgtggagtggctgttgggcgtggcgggaagcagtttcagtccggcgttctccctcgtcccttgggggaggtgactggtgtgcctcctcacctctcactcattgcccacccagagcccaggggacggtcactgctcacccacgatcaggcatgtcctcgtgtcaccgatgatgaagcggccctaggtgcgtgaggatctggctttccaagagcctgctcttccaggtgcactgagtgacgtcttacaatgttgtttgtaagacttgctccccatgccaaaaaccgcagtccctgattttaggacttccgcctgcactgagaagtaacatgctccctgctggggttttttgcaaaggaatgtaatcaaagaggtttgccggttttctgatccaggagagtgctggtttgtgcgccctggattctgtggtcctccctgtcctcctggggtgacttcttgaaacctatgccaggtgctggctgtggctcaggtctcgctcctttaagcatctccccagcaggaaacaagtcaagaaccactgccgggaaacaggatcagcggccagagattccccactttggcagaaccatga

SEQ ID NO: 84487 - DNA, 356 bp, Homo sapiens
tttatctgtatttcttttgtatatgggttaaatgtttccgttatattttctaattggctattgctcgtataaatagatgtggttttaggcacatattttatatctggctcctatactaaaaatcttttatcatttccaacagttttcagttatgctcttgggtttgaaggtagacaataatgtcatctacacataatgatacttctgttttctctttttaaatgcttatagctcttttatttttattgctttgcttgtgctataaattctagaatgaagttaaataatcatagcagatatccttttttctgatttaattataatgctcctgaaattttattaagtatgatgactgt

SEQ ID NO: 84488 - DNA, 655 bp, Homo sapiens
taatttattctatagagcctattctgtctctccccgcttcctatgtgaagtcttccctgactcaagtggtctcagttttccctgaactcttgttgacttcatcttccttaactgtcaaccatgcattgtcttccagcttgcttgtatatcttctttgtccatagccaaggctgatcagcataggacaatcaggacaatatgaatgatgctcaaatatgtgctaacagtcattttgctgactgttctggagactcccattccttttgaaaacaaagatggacttttcaaatgaagttatagttcagggactttgttttgaattattttgtaagacctgaactaataaaagccctatacagagagacattcggtagctattattattggttatctttaatgtgtacaatgctttgagcgtgatggctcaaaattactattcttagtatttataagttctactgactagattttcaatctgtcatctcagttcatatagtatatattataaattgaatcaataaaggtaaggctcattaggagattatttgccatgattaatgattgtggaagaaagaaattcatattttttccacatatttcatcttattttaatagtaatgtccttaaactttactataaaaaaatataatgtctc

SEQ ID NO: 84489 - DNA, 1535 bp, Homo sapiens
tcttaaaaatattcttttaaaacttctaattattaggtttttttttatctcttcagtacattaaaatgtctggtggtaggaaaatactggactcatatatgactgtctacatgatttgcagggcccagcgcaaaatgaagtggatgttgtacctcgttcaaagtgttaagcgtttcaagatggcaacaggagagcattaggccaagtatgaggtcattatgtacatgggtccttgtgtgaccacacaggtcacaggaacatgaagctagacctgagtgtatattcagataggtaaatcttacagatttttaaaactcaataaaagaaaaactacatttcatgtgtgaacacaaaaattggaattaaattggcaatagcattgggatttgtgctcagagtcacagtttacatctgaccacaatttctatatgaattttttaagataaaacagtaagaattttaaagaaggtttctgaaatttaaaaattataataacataattaactttgatattttaattccatgtaatttaaaacatttaatagatatataatgttccactattaatttaactagaagtataaaaataaaacatatataataaaaatattctacttatttttaaattatctatattatactgagtaaaagaaaatttaggaatataaataaatgagcatttttgaacatgtaaaaatattttcttgctgtttttaggagacttttagcaggacaggagcttacctctcatctacctctgcttggacaaaccagtgatgtgatttgcaaataggctgtaacttcaccgaaaacacatcacagtaaagaaaggtagtgactttcagagaatttgacctaacttagaatttgtaaaagagaaaagcattgtccttatgcctaaagtacatgactgtttctttttaagttacatgtatatttacctgaccaatttgttttactctgtattttaagttatcaggtgaaatggttttagaataaattaatgagttgtttcttctgaataaatgtgcatgttacaaatgcaaacacgtgtatgtattatacaactatgcagcttcaagagctgacttatttctatcagctttttattcacttaaaaaaatcaggctactgaagcatattagaatttaattacaccaattagtactgccacatcagacatatgatgtgccttcaattaagaagtacctaatgggtattagtacaatttagcttcataattaaagttctaagaacagcacaaattaaacattatgattacaaaacattaaaaatctactggtgaaattaaagctgaatatttaacttctccttttgagctgattttaaaaaagaaaatcaggattatataaaatgcaatgttattattgaagcattctgaatttaaaaacagaaattaagctcacatgcccataaatatgtgcatatacaatgattaaatatttagtaaaatacccaacctaacacttgtgccatctaataagcattaaaggttatcattttggagtttcaaa

SEQ ID NO: 84490 - DNA, 1045 bp, Homo sapiens
tcttaaaaatattcttttaaaacttctaattattaggtttttttttatctcttcagtacattaaaatgtctggtggtaggaaaatactggactcatatatgactgtctacatgatttgcagggcccagcgcaaaatgaagtggatgttgtacctcgttcaaagtgttaagcgtttcaagatggcaacaggagagcattaggccaagtatgaggtcattatgtacatgggtccttgtgtgaccacacaggtcacaggaacatgaagctagacctgagtgtatattcagataggtaaatcttacagatttttaaaactcaataaaagaaaaactacatttcatgtgtgaacacaaaaattggaattaaattggcaatagcattgggatttgtgctcagagtcacagtttacatctgaccacaatttctatatgaattttttaagataaaacagtaagaattttaaagaaggtttctgaaatttaaaaattataataacataattaactttgatattttaattccatgtaatttaaaacatttaatagatatataatgttccactattaatttaactagaagtataaaaataaaacatatataataaaaatattctacttatttttaaattatctatattatactgagtaaaagaaaatttaggaatataaataaatgagcatttttgaacatgtaaaaatattttcttgctgtttttaggagacttttagcaggacaggagcttacctctcatctacctctgcttggacaaaccagtgatgtgatttgcaaataggctgtaacttcaccgaaaacacatcacagtaaagaaaggtagtgactttcagagaatttgacctaacttagaatttgtaaaagagaaaagcattgtccttatgcctaaagtacatgactgtttctttttaagttacatgtatatttacctgaccaatttgttttactctgtattttaagttatcaggtgaaatggttttagaataaattaatgagttgtttcttctgaataaatgtgcatgttacaaatgca

SEQ ID NO: 84491 - DNA, 209 bp, Homo sapiens
agagatgggaatctcaacatggtgcccaggccaggtgggacttgaacttctggactcaagcaatcctcccacgtcagcttcccaagtagctggaactatagggatgcaccatgaactactaatttaaaataaactttctcctttattagtattttttagtagagacggggtttcaccatattggccagggtggtcttgaactcctagcc

SEQ ID NO: 84492 - DNA, 141 bp, Homo sapiens
ctcacagaaaaacagctggaaggagtttggaggagaaaaaaatggatgtgataaaggaggcaattaaaaacagcaggaaaaacaaagagccgtgccagatagtaatctattactacacatgattgtctctggaatagttta

SEQ ID NO: 84493 - DNA, 485 bp, Homo sapiens
tgaggattaattgaaacattgcaagtacaatactcagcataaggctcagaacacagaacacattccataaatggtgctatgattggtcctgggatattgggtcctggtctggttggcagtgaaggcaaggaaaacatgtgtgtgggatatgctgacagtttaggggatgtcctagagtttcccatagttgtcccagtcagtttgatcttggtattatgcactaggctgtgtactgtttggccccagttaagattccaggtctgagaacatttttgaagcccctagatggatgggctgaggtgatgaaagaggtaactttgatatgaactatgcctcaataagtggggttctgcaaactgggggaaggcagggcttgaagcttgacagctttattagttcaaagagtgttttccccaaatatgatttaatttaattttaacccttatagcttgcatcaccaaaattgtccccaaatgaagaaacaa

SEQ ID NO: 84494 - DNA, 753 bp, Homo sapiens
  misc_feature (27)..(27): n is a, c, g, or t
aagcaggctggtacgccccggggttanggatccagctccgccgagaggccgctcgcgccgggtccttcctcttccccaagtgcaggcagagcccccggagccatggccagcccttccggcagctccgaagccactggcaagccccgaggcaggatggccggcccaggagggaggaggacgacgtccctcccgaagagaagaggctgcggctggggctggaggggggaagcgcacagcccgaggactgcgaggacgggaaggacgcgccgcggccgggcagggaggagaccggcacccagacaggtggcgacggcagaggagatctactgtgcctgccatacagcctggttgagggtcaggactacaagtctgaaaattcaaccctcctccccggtgccaagaacagcctgcaagactccgtaagtagaagcattttgctgaacagattagattttgaaactacttttgcatccttttcagcctctttggtctccgtcatcaatcaccgggaatggtttttacctgaaactgatcttgctggagaattaactgggtttgaggggaataaattttccagagcacttgcacaatttctatcacttgggccgtattcccagcctctggtacatggtgtgagagctgtattctgtcctctaaaaaagaccaggcccacttggtggacagatccggggcacagtggttggtgacaaggctgcaaattggtccctctgcgccctggtgtgacggccccag

SEQ ID NO: 84495 - DNA, 360 bp, Homo sapiens
ttttcttctaaatggtaatttatagattttcagttcttatttatttattttaaagagactcttgtctgaaaaaaacaaacaaaaaagcagtattttcatatgatttagattattaagatgtcttcatggtgtctggtagcgtgtttaccctttgacataataaatggctgttgattaggagcaaccacggataccaagctgcagccaggtggtgagggcatcacctcccatgtgatggaaagagtgcctgcttgctgtcaggagatgtggctaggatcctggcactgctactgacctgacacttaagcgtgggaaagccagtcaaccagctgcccagagccttagctttctcacctataa

SEQ ID NO: 84496 - DNA, 810 bp, Homo sapiens
ccgtctcagaaaaaaaaaaaagaaaaggcctccttttaccatcctgaaatgacattcacattcatgtacattacaagtcttgctggtgtgggacagccccccagcaccagacctctgcccattcagtgccaaagcaccctcaaggaggaattcccaaaacacaccccgagggcaggcaggaacaggacccttgtctgtctggttcagcgcggaatccccaccacctaatacaagaccctgaatgcactaagtaaataattgcagtctggataaaaaaaaaaaaaaaaaaaaaaaaaaaaaaaaaaaaaaaaaaaaaaaaaaaaaaaaaaaaaaaaaaaaaaaaaaaaaaaaaaacaaaaaacaaaaaaacaaaaatagcagcaaacagacagaaagaagacaaaagaaacacaacacaaaagagaggaagaggagaggcgatgaacgtgacagatcacgcagacagacggagaaacgcgagcgaaagaggatgaagaaacggatcaagaaagaggaacggagcggtcggcgggatgagagtgatgcggaagtgataagtaacgaatgtgaataacaaagaccaatgacaggcgccgtaaatcaccacgatcgaaatcaaagcatgaatgataaggtttcaactaaaagagagaaaaaaaccacagagacgaggacgcagaaacgagagacagatcagataaatgaagatatacagaaaacaagaacataagcaaaaaaaaaagagcaaaaaaatactaaaaataagaatacatttaacttatgaaaagacaaaagagatatatagtacat

SEQ ID NO: 84497 - DNA, 444 bp, Homo sapiens
gaaggctgtatatcagctgtatatcttcaaagtaattggtgaaagcagggttttgggggactgcaggagggcgattttgctagagtataaggtttctacctttccactaactagttctctgaatttcatctaatgatttaaaggtgaatgtggggatattttattagtaactaccttctatatcacattattgaattattctgtacttactctgaacactgaatgtttgaaccaaaaactaacttcttcagtaatagtttacttcacacgtcacccctctcgcattagttttgttaaatcagttttttctcaagcttagtatttctaacattttgtcatcaattaaaagaattactagaaattaggagttttcttgagggtagtaaagggaaagattcatggtttgcagatgattatattactcatttaattgtttagcttata

SEQ ID NO: 84498 - DNA, 351 bp, Homo sapiens
ttaatatacgtctttctttaatatacaatgagcttataaagctttaatactttttaaatagctatcttatgtctgctgttattttgttgtaccttaatgacgtaatggatttttaactaataaaatacacatattaaaagatataaagagtcacgagaattaaagtcagttctatttgaataatatataaatcccactgaggtttagtatttaaatcactttatgaaattaatcctacttagaactgacaaaaacataattttgatgtacaaaacaataatacttcaagtataataaagctgttgacttaataaatattttctacgccatggtagaaagtcaatattttaa

SEQ ID NO: 84499 - DNA, 373 bp, Homo sapiens
attttcccttagctattctatcgtatgtgtcatatgtctgtgatatctccaaatagtaaaataaaatttaaaaatccatccatttctcagctgggcacggtggctcacgccagtagtcccagcactttgggaggccgagacgggtggatcacaaggccaggagatcgagaccatcctggctaacacggtgaaaccccatctctactaaaaatacaaaaaaattagctgggcatggtggcagacgcctgtagtcccagctacttgggaggctgaggcaggagaatggcgtgaacccgggaggcggacttgcagtgagccgagatcacgccactgcactacagcctgggtgacagagcaagactccatttcaaaa

SEQ ID NO: 84500 - DNA, 439 bp, Homo sapiens
  misc_feature (51)..(51): n is a, c, g, or t
ccaagtaatgtagtggaggttgtttttacaaaaacagaaaaatatgcctcnccacatagaaccagagcagaaatcagagagaaaatcacccacaaacccaggaaatcctccaattgcattttatcttatttccttcagtatctctgggcaaatttttttttttttttcctttttgagatgaagtctcactccagcctgggcaaccagagcgaaactccgtctgaaaatatatatatatatatttagagtagtgcttgtcacatagtaagcctttgttgttgttagcgcttactgtgtaacaaatcactgcaggctcaaaacaacagtcatttattcagctcataaatctgcaagttaggacagttggccctctgtatctgtgggtaccacactggagaattcagcaacggtggatagaacatattcttacaaaaaaaat

SEQ ID NO: 84501 - DNA, 387 bp, Homo sapiens
tgagacgaagtctcactctgttgcctaagctggagtacattggtgtgatcttggctcactgcaacctccacctcgcaggggaatcgcttgaaccccggaggcggaggttgtggtgaactgagatcgcgccattgcactccagcctgggcaaccagagcgaaactccgtctgaaaatatatatatatatatttagagtagtgcttgtcacatagtaagcctttgttgttgttagcgcttactgtgtaacaaatcactgcaggctcaaaacaacagtcatttattcagctcataaatctgcaagttaggacagttggccctctgtatctgtgggtaccacactggagaattcagcaacggtggatagaacatattcttacaaaaaaaat

SEQ ID NO: 84502 - DNA, 795 bp, Homo sapiens
cgacaagggcctccttgaggatggaaggcaggaggagggaaaggatcagaaaaaataaccattgggtactaggcctagtacctgggtgataaaataatctgtacaacaaactcccgtgaaatgattttaattatataacaaaacttgcacatgtacccctgaacctaaaataaaagtttaaaataaaaaaagagccaaattaaattattaaaataataaaataatttcttttctttttgaagttttaagacacatcaattaggaagcctggaggcatcttagatggcagacataagccttttatgttcaatgtaaataattatattaagtgttaattacccaaataaactaactaaaagacagatattaacagagtagatttaaaaacatgacacaattatatgctgtctaccagaaacttcaaatataacaatatatgcacactaaaagtaaaaggaggggaagagatatatcatgtaaacattaatcaaaagaaagcaggagtgactatgctactatcagataaaaacacagacttcagagaaaaaaaaattaccagatacttagacattccagagtcaaaatgtcataaaagggccaatttaccaagaaaatatagcaatcctacacgtacatgtaccaaatacagatcctcaaaatatgtcagagactgatagaactgaaaggagaaatagacaaatcataaatccatgctttatacaaaaatttactcaaacagatcatggacttaagtgtgaagtacaatactataatttttttagggaaaaaaaccct

SEQ ID NO: 84503 - DNA, 1032 bp, Homo sapiens
ctgccttagcctcccaaagcactgggattacaggcatgagccacgaagtatggccatagagcactaaggtgtcactggccccagagcagagtttccaggctgcagaagtgagcctcagctacctgacttcaccttacctcaccctctagatcctccctccaacctgtcccccaagctagagaagtgaggcttaatggtaagagcacacccagctggaagtcataaggcctgtgatcaagtgctgacccctttattgtgtgacatgggacaagcatctgtgcctctgtggcctttgctgttcttgtcttgatcagagcctacatgaactggagcctgcatctccctgcctgtccacactggggctgcaacagtgggcaatccaggaagttgtcaagcaccagggcctttttggagtggaagtagcgcttctgctttgtgggcctcggatctccccacttctgactcagccttcctccatcagtttcacatgggaaggcacagaccctggcactatcctgcagcccaatccataactctgaactcaactctggattctaattacttgtgcatgttacctgtccagagagagctatgtgtccagacaccaccagagggtctcaggaaggagccaggcaagggactccaggatgcaatggggaggggggcagaagaggtagacattcagaccaccactcctccctttaagacaactgctgtctccaccctgtctcctgctgtcttctgtaaagccaccagggtggagacaaggtagagccgagtcatccacccagctgccttgcctggggtggggcccagctgcaagcctggactccagacaggcttccctggtgcttacaaccttcccattctgcctgcacttgggtatccaaatcccttgggctacagactagaaagagacagagaaggggcagggggtaccaggtgcggtagctcatgcctatacatcccagcactttgggaggccaaggccaaggcaggtggattacttgagcctaggagttcgagaccagc

SEQ ID NO: 84504 - DNA, 487 bp, Homo sapiens
taaggtcagtgcttttagcttgagacccttaggttggactttcatattatcttaaaaatctgcggggcacagtggcttatgcctgtaatcccaggactttaggaggctgagtggatcacctgaggtggatccacctgaggtcaggagtttgaaatcagtgtggccaagatagtgaaaccccgactccactaaaattacaaaaaaatcagtcagccgtggtggtgctggtggcctgcgcctgtaatcccagctgctcggaaggctgaggcaggagaatcgcttgagctggggatgtggaggttgcagtgagcggagatcatgctactgcagcctgggagactgtctcaaaaacaaaaaacaaaacaaaacaaaaaaacttgtaacaatttttactaaatttatttaaagatggtaaagtttctactcaccttttatttttgccttgtaataatttcaaattagtactttatcttaaaacattttattt

SEQ ID NO: 84505 - DNA, 446 bp, Homo sapiens
acaggtgtgcaccaccacaccaggctaattttttgggtatttttactagaagacagggtttcaccatgttggccagcgtggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaagtc

SEQ ID NO: 84506 - DNA, 215 bp, Homo sapiens
tactactactaaattcgcggccgcgtcgacgaatttctatttggtctattcttttggttcctgagagagaaatgatgaagtctccaagtgtaattgtggatttctctatttctcctttcattttcttcagctttgcttcatctgtgttgaagctctattcttagatgcattcacatttatcaattgttgcaccctctacatctcttggtaatttt

SEQ ID NO: 84507 - DNA, 606 bp, Homo sapiens
aaggagaaagcttaaataacttgcccaagatgacacagctagcacagggcagtgcttgagtaacttcccgaggttacacaggtagtgagaggtggaattgctaggttgttcagcaccacacttttctcccctctacctcaatggttcctggctctgtgtgggtgtctcctagcagataaaatggccctcttccatttacatttgtcttatccttatatcttcaaaatggttcgtaagacaaaaagagcctgcccttgatagactgcctcccactgcagcaagtctagcactgagcagccctaagactagaatgccaacttcgtagagggaggatagataggaaaggctcctgagacctggggcctgggagaaggaagtagtaggttcaagattaagaggaggtgagtgatacgtgtggctcagacataaaatgtaatgcccaccaaaaaactcagtcattcaatctaagtaatatttactgaaatgatttttaaaatcacagtatgagaaacccgtgaagaacaaaatattcaaacttgttaaataaagacaggatccggcagggccagtgtggtggtgaggcaagtgaggctaagttatgtaaat

SEQ ID NO: 84508 - DNA, 246 bp, Homo sapiens
cgaggcggcaggggggctcaggccctccagggccacgtgacgtccacagcacggccccggctggggggcaggctgtcccgtggctctgcaccccgcgttataaacaccaaggtgggatgaaatgcatcctctctgcttagcacgggccttgctcaccagcctggctcctcagacacacctgggattgccccttccaggacaggccagcccctttcctgctttcccaaaatggtctgggtggcagga

SEQ ID NO: 84509 - DNA, 514 bp, Homo sapiens
atatttgtcttgttcacaatctgtattcccagcatacacaagagatgctcaaaacatttgctgagtaaaataatgaaaactcatattagaagctgtaacagtgtagggagtgcttgatttggcagataaggaaaacaaaacaagaaatgcaaaaacactccctgcactccaagtgaagacatcaggaagcatctatttatccctagttcaaataagccaaataattataaaagttaaaaagtcgtttgccaatctttcggttattaatgtcagagtcttcagtgaacaactaaaaagtatcaacactgaatcagtgctataatatatccaattttaatagcacctacaagatatcctgaagatactgtctctcaaacttagtctcttgccagcccatcattatccaacctttatgctcctttttaatgggagcagaaaaggaatttggcctagcaagatcttgctgaaccgtaagaactaactcaaattgtctctttaggatactactgctaac

SEQ ID NO: 84510 - DNA, 490 bp, Homo sapiens
attgccttttgatgccaaaggtccacaaaatccaaattattctttcccttgtgggtcatgcttttggtgccaaatctaggaaatcattgccaaattcactgtaatacagcttttgccatgtattttcatctaacagttatacagctaagatggacactcacatatttcgttcattttaacttctgtacatgttaggtatgggtacaacgtcatcctgttgcatgtggatgtgcattgcccaacagcatcattctacagaaacattaagctatcccccattgaatagtcacagcagacttttcagtaattgttagactttatgtaaattattagactttattagactttctgtgttatcttgttgcattgtctatttctgcgttattacgctagtaccaaacagtttttattagtatggatttgtaataagttttgaaatcaggaagtgtgagttcaccaactttgttctggctttttttttttttttttt

SEQ ID NO: 84511 - DNA, 640 bp, Homo sapiens
ctgctgccatgcagttcccctgtgccctgtgggcttgtcctgctgtcatgccacccctgtggccctgtggggcctgcgctctgtgcctgggggcgctgggaaccggcagcctggatgccgtgatggtgctggtggagcatgctgatgcctggagcccctgtggctgctctgaatgcatgtgatgctcgtggtccccagcatccttgagccaccaggagtgagggctgctgctccctgagacctggctccaaggaggatgccacagccgcctgccagctccggtctgcaccatgagtgatgagcggcggctgcctggcagtgcagtgggctggctggtatgtgggggcctctccctgctggccaatgcctggggcatcctcagcgttggcgccaagcagaagaagtggaagcccttggagttcctgctgtgtacactcgcggccacccacatgctaaatgtggccgtgcccatcgccacctactccgtggtgcagctgcggcggcagcgccccgacttcgagtggaatgagggtctctgcaaggtcttcgtgtccaccttctacaccctcaccctggccacctgtttctctgtcacctccctctcctaccaccgcatgtggatggtctgctggcctgtcaa

SEQ ID NO: 84512 - DNA, 428 bp, Homo sapiens
ccactgagtctctctaggttctgtctcgcaccctccagagtgcgtgtggtgtgccaaggcctccggcgtactttccgcttcttgctcatctgctccagttagcctgatgttaaaggtataatgagccactgtgatgttctgagttgaaccagatcatacaggccctctgggactactttgctggagggtgggagggttaacgaggcctggggcaggactacaaacgtacactactgcctagcctatgtgagagtgaactgagtttcatctttctgataggaatggaaaagaaggcattcctagatcagtgtgtgcacactgcgtcctggggggatgttactgtactctagcaaaggtaccacatctggcacagcagctgtgaatggcgctgcttcttagttaagtttgtggtagctcactgtcatcac

SEQ ID NO: 84513 - DNA, 826 bp, Homo sapiens
atatggtctaaacagaaacatgtatcctaaaaccataactctaaacttgttaatttttatcataatctcttttcttaacttcagacagatcttctaccatatctactattgtgtgtagtaaagaagcacttatttcaaagttctacaatttgattaggtacctttagtttcttttcctttttataaatgtaggtaaaaggattttaatattttttatttaaaataacaggcatacaaaattgacaaatgggatctaattaaactaaagagcttctgcacagcaaaagaaactaccatcagagtgaacaggcaacctacaaaatgggagaaaatttttgcaatcaactcatctgacaaagggctaatatccagaatctacaatgaactcaaacaaatttacaagaaaaaaacaaacaaccccatcaaaaagtgggcaaaggatatgaacagacatttctcaaaagaagacatttatgcagccaacagacacatgaaaaaatgctcatcatcactggtcatcagagaaatgcaaatcaaaaccacaatgagataccatctcacaccagttagaatggcgatcattaaaaagtcaggaaacaacaggtgctggagaggatgtggagaaataggaatgcttttacactggtggtgggactgtaaactagttcaaccattgtggaagacagtgtggcaatgcctcagggatctagaactagaaataccatttgacccagccatcccattactgggtatatacccaaaggaatataaatcatgctgctataaagacacatgcacacctatgtttattgtggcactactcaca

SEQ ID NO: 84514 - DNA, 278 bp, Homo sapiens
tcactccatgcaggcagccatttgcctgcacttcagccctatctacaactgacggctatcagtaagtacctaataaactccagatgccaaaccagaagtggctccttccttcgtgatcagtatgggggtgcccctagtgagcaagctgggggcgaggaggtgggaatggggagggaggaaacgtgctcctggaatctggtcagctgggtttaagttttatctcttcatggtttatcaaacgtttactaaagcctggtccagcccaggccctaactgag

SEQ ID NO: 84515 - DNA, 392 bp, Homo sapiens
tgagagggagggctgctgggccaggggcaaggctggcgccaggccgtagggaccggcttagtcaggagcacgggtccatggtaaaacccaaaggcacccccacacactaggatggctaatgcccaaagaacagaatgtgttatgctggcgacactgtggagaaactggaactcttgcgcactgttggtgggaatgtaaaatggtgcagccactgtggaaaacaggatggcagttcctcaaaaagttataaacagaacgaccaaatgattcagcaattccacttctgggtccattctcaaaagaatcgaaagagatacttgtacacacatgttcatagtggcttactcacaattgccaaaaggtagaagcaacacaagtgtccacgaacggat

SEQ ID NO: 84516 - DNA, 650 bp, Homo sapiens
gcggaagagagatcaaagggaagacaagaaatatcctgggaggtttcaggatctaaagttaccatgaagtcaacctaacctcctctggaggtcctcccagtcctcccgtggctggcgatggtgaatcgagtttccgtctccagtttgccaaggcggacaaagccgacacaatgggcctgtccactatcttctttcatatacacaaaatgtcagcttttcctgtttctaactggcaacatcccgcctgatgaccagcttagcaaattagagactctccatgggattccatctgtgtcttagttcgggcttctctaacactgtaccatacataaactgggtggctgattcacaacagaaattgatttctcacagttccggaggttggaagtccgagatcaaggtgccgacatggtaggtttatggtgagggccttttgttctggttgtagactgccacctcctcattgtatcctcagggggcagaaagagggcgagagagctccccgaggtcccttttataagggcattagtcccattcagactaatgggactaaatccagactctgtgctgagtgttgtggattttttgcatgttcatcctccccgcaggcaactggagatgtattgtccccagagggtacaatagagaat

SEQ ID NO: 84517 - DNA, 920 bp, Homo sapiens
tacaaaaattagccaggcatggtggtacacatctgtaatcccaggtattcggaggctgaggctggagaatcgcttgaacctgggaggcggaggctgcagggagccgagatcacgccactgcacttcagcctgggcaatgaagtgagactctgtctcaaaataaacaaacaaaaagaaaccaaacaaatatcttctcccagtgtatcaactgtctttcgattttgtttatttattttcttttttaaactctgcctggttttccctttcccatagaaaccccaataaaagcgatggcctaggctttaccctcagtcctgcttctgcctgaccaaactgtatctctcctgtggctctgtgtgatgtgacttgtcctcttctccaaggaagtattagtcataaattcttctttcagtggcactgatctgtgtcatcactcagtcaaccgcataaattaagacctaggcacagaacaactctgtttctatttctataaaattctagaaaatgcaaactaaaccataatgacagagaatattagtggtttcctagggatgggatgtgggcaaagagagacgaaggaaggagggattaccaaggaggacagggaaacttcgggatgagggatatgctcattatcttgactggtgatggttttacaggtgggccaaaactaatcaaactttacacttcatctatatgaccagctatcatatgtcaattatacctcaataaagctgtttaaaaacatttagggtatatctactggaaagtaaaactttttaattatagactctatcatcacgtgcatagaaaaatccaaaggattctacaaacaagctactagaaccactgactgcatcaagatgcaggtacaaagttaatattcaaaatcaactatatttctatacaagagcaacaaa

SEQ ID NO: 84518 - DNA, 177 bp, Homo sapiens
tcgagatcgcgccattgcatttcagcctgggcaacaagagcgaaactctgtcccaaaaaaagaaaagaaaagaaaaagaacaaaatgccttttcctctctttgtttccatggagaatataacctggaggggaatgaatatagatggaaaggaccagcaacatgacctttttcccact

SEQ ID NO: 84519 - DNA, 375 bp, Homo sapiens
agaacttgagggacacatgcggttaagaggaactgtggaagaaaaatgtactagagaaagggaggagctgtgggaaagggggctctgggatcataacagtaacaagcccttatatattaatagctcttaatgtatgcaatcacagccacatattatgtgtagtaaatcatttcatcttcatgacagtacaatgaggtaggcactattagaatccccatattacagataaggaaattgaggccccaatagggtaagctcaggaaggtgattgcagagataggacccaagccagctgtttgctgggctgcctctcccctgggagaatgacctagaatggaggaggcaggagatagccagcagggaccaacattctct

SEQ ID NO: 84520 - DNA, 160 bp, Homo sapiens
ccagctgcgtcagctcctccccggaaggccccagctgtacctgctccatcccagaaggccccagccgtacctgctccatcccagaaggccccagccatacctgctccatcccggaaggcctcagctgcgtcagcttctccccgaaaggcctcagccgtac

SEQ ID NO: 84521 - DNA, 332 bp, Homo sapiens
tctttatatatttgctgacaccctgcctcattccaaaaaggatctgacagctcttagtctattccccttctgtcttcacccatccccatgactgcagtaaatataactttgataaatacagtaaatgccaacaaaacaaaaatccttcctcttctcctcatgaacgaaaaaaatccaagatttcccccaatgatattttctgcacattaattcattagttctttataggtagagaacacatccttttagttattttgatacattgttacttagcgtcttctacaccagaggtccccaatccccaggctacacatcagtactggtctgcagcc

SEQ ID NO: 84522 - DNA, 454 bp, Homo sapiens
aattctttttttttaaataaattactcagtttcaggtattctaagcaacagaaaatgaactaatattcatgctgatttatagcagaacagtgtaagtcaacattctttcaaaaccaggataaaaattatctcatcataagttatcactgctcacgtacgtaaccacggacgggttatctaaccactccacacctattttttttccttgttaaaatgttgatgctacctgtctctaagtaaattaaatgagctaataatacacacagaatttaaaacaatgcctgaataatcaatcagtgttgcctattacattatttatccctgttatgctcttctgtaccctctttagaaaataattccaagactgaaattataactctagacaggtgtggtggctcacacccatacactcagcactttgggaggccaaggcaaaatcgcttgaggtgaggca

SEQ ID NO: 84523 - DNA, 704 bp, Homo sapiens
tgcggaaatacggcttggctgagtgccgcgttcggccagggccagctcccaggaacagccgggctgcgaggccatgacccagggcctgggaacacagtgaggcctggccatgctgcgaggcctcagaggggcggactgcttaggaggccaacgaccttcctaagggtgggcagtcagggaagggccaacagcatgcccgctgtgtcctcaggcgggccctccctccctgggaccctcccagtgccagcctcctgcctgggccaggctgggagctccctgactgctctggtccctgggctgctcccacgagcctgactctgacggtgtctgctgcacatcatccgcggagtcccgagtttcggccactgcggtcgtccccatttcacagccaggaaacagaggacaggggaagtcaactggaggtcacgcggtggtgagtgacagagtgggtgttgcaggcaaccactggacagagccacaaccacactctccccagcacaccccactgcccctgtgctgggggactgctccccatttcacagatggggaaaccaaggctggcgggaggagcagcaggagcacatccgtggactctaagtcagcaccctgcctgcacacgcagccccaatccccatagtgaggtttgcctccccggcatgaaccaggaacgtccggcctcatcgggaggctggcaccaaaatcca

SEQ ID NO: 84524 - DNA, 420 bp, Homo sapiens
acacccaacatttcccttataccttcttccaactgctctcctgccatttccagaagttgctttcatttcattcactaaacagtttacgaactgaattaaaataaatgagatgcaaataaattcccaggctttctccctcattttcaaattacattttcagtccactcaacctgttataatctcatagtgattttcatttaagagagctaaatggatatgtgattgttgttacaggaactaacaccagacaattaaatgttgaggtgttgatagataaaactgtgttttgatttgcataaacacgatgccagcaaatctaaccctggcagaaattcagttataagacttgtgtgcctaacttgggctaattaccacaagtaccattattaaagaaagagttttaatatttggagttgggat

SEQ ID NO: 84525 - DNA, 369 bp, Homo sapiens
gtgctggggttttatacacatcatctcactcaactcttacaaccaccccacgcaacaaaatcaacaccaccacccttctcgaggaggaagccgagacctgccaggtggtaagggacaaacccagcagagaactccatccttcccttaactccacagggaatcccaagaaagggaatctcaagtccttcttggtaggtgagttaggagctttccatcaacagggagcagtggttaaggacacgtggagaatcccagctccttggacagggtgttccccctcgacattcttgtctgtaacatggggtgatggccaggcgcggtggctcacgcctgtaatcccagcactttgggaggccgaggcgggtggat

SEQ ID NO: 84526 - DNA, 665 bp, Homo sapiens
aagacagccacctcgccaagatcgtgtctcccctttctgaggaagcccagagctgatgactggccatatggatataaaacgcacaaccccctcaggggaactccgactcgggcatctctgaaggactatggggtccagtgcagcacagagtgggacattactttctgctgggaagacccacttcccaatcaagggagcatttggtctgagtcctgaagggtggttggttaagtggcaaatacgcagagctggagaatgaaggatttttttttttaatactttaagttctaggatacacgcgcacaatgtgcaggctcagctttctcatcactgaactggagatacaggtaatagtaatatctacccctggaggtatttttaaatacttccacagtacctgacacgtggtaagttttaacaatgctgatggaggaaacatttggatgtttccagccaaattggaggaatcaacgagtcttgtctactgattagatatagaggtcggaagatggaggatggaggtgaagccaagatggctctaggtatctggcctgagcaagagaactgacaacagttggtatttgggtttgacttgaaggcaactgtgggccatctagatggagagaggtacagtggcatcttggaatttctaaaataaaatacat

SEQ ID NO: 84527 - DNA, 332 bp, Homo sapiens
tgtggtttttaaataagaccagatccttttcaaaataaacctaattgagtttgaaggtataaggaaattttaaaaagcacttctgctcttggtagcatttctgttgatgaactgtgatgacatgtatctttttagtagcctttctacctcatgagattgttgtaaggataaagtagatgttccagaaagtcaaaatctataaacggaagaaagtggtatattttgagctcaggaagctttgtgggtatccattctggatttcctttccagaattttgcacacctccattaccttagtcaaattttgcctaggagtttatgttcagattgggg

SEQ ID NO: 84528 - DNA, 123 bp, Homo sapiens
taagtggttctttctaattttttagaaagtctctcttgctgtgcatttaactacttcagtaaaaatactgacaaggagccaaaccaggagaaaaaatctacttattaaactggaaataatgta

SEQ ID NO: 84529 - DNA, 682 bp, Homo sapiens
aaagaaaaaaaaactttgaaattttaaaatattatcagttaaattaaaataaatgtgcaatttatcaaaatttatgggatgcagcaaaagcagtggataggaggaaattattagcattaagtgcagatattagtaaagaagaaatatctaaaattaatcgtctaagcttctaccttagaaaactagagaaagaaaagcaatttaagcctgaagtaaaaggaagaaaagaaataataaaattagagcagattaataaaattgaaaacagaaaaacgagagagaaaaaaatcctccccaaaatccaaagctgattcattcaaaaaaattaataaaagtgatgaacttatagccaggctaatcaagaacaaaggagagatgacatttattatcaatgtgagaaatgaaagagggataatcactactgagcccaaagacatgagaaaaacaataaaggaatactattaacatttctatgcctacaaatttgataacttagataaatgggacaaatttcttgaaagacataaactaccaaaactcacacgagcataaatagatagtcagcaaaggtctatatctattgaagaaattgaatcataattaataaacgtacaaaaaagaaagactcatgtcctgacaattacactagtgaattttaccaaatatttaagtaagagatgat

SEQ ID NO: 84530 - DNA, 376 bp, Homo sapiens
tattctgattagccctcgcattttaaaaacatgaagccagtatacttaatctctaagacttttaagttattttttcctactaacttctgtggagagcaactttgagacaactgtttaactggatattattctaccaaacatatctgattattattagctttataaaaagatggtaggtttgttttataacttaggtagtagaaagaatattatatttagaatcaaatagactttggtattactcttatcacttactaagtgtgaccttgatatagttaacttctctaaggctaaattttctcatctctaaaatgggagataatagaagtctcagaatagattgcctagagaatgaaagaggaagaatatgtctaaa

SEQ ID NO: 84531 - DNA, 144 bp, Homo sapiens
aattggatgaataaattttgtgtatttgtttttctttaagtcatattagtttctaattacatgtccaacaagagaataggaaagtctacaaataaataatatgtcatttttacatgacattaccatctatcatcaataaaacct

SEQ ID NO: 84532 - DNA, 274 bp, Homo sapiens
tcccaaaataaggtagtagttaactagcatagcaccttgccatactcctcaacctttccccacctcttcttctgtttcacttttctctttatccctttatcctcattcattcattcagcaaacaattattgctttttcctccctgacaggcctgggctggatgctggttatataagcagaaataaacaaggccctgtttatttacagatctcgttctccaggaatacaatgtctacctgcttgcttgtttgcttgcttccttccttccttcctt

SEQ ID NO: 84533 - DNA, 179 bp, Homo sapiens
cccttgtaaatctgaaagtgctgttggtagcaaccagggatgggcagaggcagccctgtcctgagggtgacatgaaagtgagagcaagctgaagctccagttggcttagtcttcaaaagtgtcactttcagattatatccctcagctttaaaatatccttctttgaagtccatccctgc

SEQ ID NO: 84534 - DNA, 175 bp, Homo sapiens
tcatggaaaataaagacaattttgcttaaaggcaatattagtatatgctgcctttataagatctattagcaaacgtctagtgagtattacttcaagtctctgtcactactaagaccaaagcgcctgagtctttcaaccaatctgctcacctttctattttcctgtgccaaaccct

SEQ ID NO: 84535 - DNA, 176 bp, Homo sapiens
ttccctggagccatttctgtctctgtgaaataggcaatttaaggtccatcccatcctaaaagcttttagcttgtgaaaagcttcttttcttgcttttaaaaccttcactctgcgtttagaataaatggcattcctggatctgttaaataggcagttaataatgccacagaaactac

SEQ ID NO: 84536 - DNA, 365 bp, Homo sapiens
aaagttcgtgtcacattctttttacgttttcagacaaggtgtggctctgttgcccaggctggagtgcagtggcgcaatctcagctcactgtaacctctgcttcccaggctcaagtcgtgggatttcgccatgttgtccaggctggtctcgaactcatgagctcaagccatctacctgcctcagcctcccaaagtgctggggctataggtgtgagccaccagcaggtatcacattcttgagaacaattgataatttgtatcaggagtcttaaaattgtttataatctttgaacaattttgccagtcaataatgccatttctaagaaactatctgaaaggagttaccagaaattcattttttccaaa

SEQ ID NO: 84537 - DNA, 816 bp, Homo sapiens
gcggtgcgaagagccgggcggcggccagagccctccccgcgctgccagtgggacgcggagccagggatccccggctttgccccggggctggggtgcaacagactcttaacttggtcctcgcgccccgccaaccgccccagggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggatgtggctgggccgccgggccctgtgcgctctggtccttctgctcgcctgcgcctcgctggggctcctgtacgcgagcacccgggacgcgcccggcctccgggtacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccc

SEQ ID NO: 84538 - DNA, 401 bp, Homo sapiens
tggacagccttggaacaacttaaaaaatacaataggtctcaacccaccactgtgtctcagtgctggcctccgcctgccccaggcctgttcttttaacactagatactaaattcagaatgagtcccttctgagtcaattactgtggtgagaacaacagaataaactgaacgcatcccatcctcttatctccattgttttctgtttttccctgacttcacttacccactgaggaaaataacatcccccatgatgaatttttccctcatcctttaaaactcataaaccaggaggagccccttttggtgccaaaagaagaaagcacaacactgtgaacctggtttccctcctcaataaggaacagtagagtggacctggagacaaagttgtcagagcattctctg

SEQ ID NO: 84539 - DNA, 963 bp, Homo sapiens
gcttgggggaccgtcctccccttccctatcggccccagaagatagctgccctgtcatctccgcgagaacaggccctctgcccatccccttcccttgaagtggctgtctcctccccgctcagttctggaagatgtccgctccatctcatcgtcccgaaggatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaaggatgcctcagtgctctccatgatcccagcactgggctgagcctcagggtgctagacctgtcctcctgtgtggccctcacaacaggaccctgcaggccatctgcacctacctcaccacctctcagtcctgcgcctggcgtggtgcagaggagctctgtgactgggggcttcggggggcctggggggaggcctgtgccaggggacccaggtgtggggaccctcgaggtcttgagaggaacgcgggtggcccctgggaatcagactgcccctccttgcccctcccaaagtcctctgtaggagtaattcaaagggcaaaacctcagggacggaacctgagaaaggcaaagggctcttcccacaagcaggcccagagctggagcatcaggcctcaggtaccaagggacgccgtcagaagcacacagggcccc

SEQ ID NO: 84540 - DNA, 467 bp, Homo sapiens
gtgtggtggtgcatgctggtgagcccagctaattgggaggctgaggcacaagaatcacttgaacaggcaggcagaggttgcagtgaaccgagatcacgctactgcattccagcctgcacagcagagtgagaccctgtctcaaaatagtaataataataataataataataatagtaataaaaataaaaattaaagaaaaacagagcccaacgtcaaagcaatatatacgctttttagcaattacgctgaggcgggaggatcacgaggtcatcctggctaacacagtgaaaccctgtctctactaaaaatacaaaaaattagctgggagtgttggtgggcacctgcagtcacagctactggggaggctgaggcaggagaatggcgtaaacctgggaggcgaagcttgcagtgggccgcaatcgtgccactgcactccagcctgggcgacagttcaagattccgtcttt

SEQ ID NO: 84541 - DNA, 397 bp, Homo sapiens
gttataattatcttgttttattatttattgtttatctcttactgtgtataatgtagaaattaaactttaccataggtatatacatattggaaaaagcatcttatatacagggtttgttactatctgtggtttcaggcatccactgggggtcttggaacatatcccttgcagataagagggaactgctgtatccatagaataaaaacaccccatcttgaagataggaggattctgtaaattgggatggggtcagggaatctgaattttaaaagtttcccatgtgatttgatgcccagccaaggctggggaccactgtcttgaaatataatgctgaggaagatactgtctttgattttcctgtaattcgagtgcaaatctcagctgaacttatggcttg

SEQ ID NO: 84542 - DNA, 1123 bp, Homo sapiens
atcaggaagggtcacgtgttagagctgtggtttacattaatatatacagtgttaggaggagcataaagaggaaaacaccattgtggcaaagtaatcctgtggaaaccagagagagagagatttgataaagtcttggtgactgacctgagtacgaaaccagtggtggtggtagtgggaatctttagattaatgaatattgatttattcataagctacaaaattcaaagggcacccagtttctctttctagaggtaattactatgttcagattcctgggacctttccaggtatctgatgtataaatacctctctctctttccctctctttctaacacagatattagtattcctctgtgtcttactttatccccttaatagtatatcttggaaatcattgttttctttaaaaaaatgttttaattgaggtaagcattcattatacagtaaatgtcttgttccttttaactggctgcataccctgtcaacctatggctgtgccaacactggagagagtctgggttgagtatagtctttttgccattataaacagggttgcagtgaacattcatgtgtatacttctttgtacctatgtatgagtgtatcctggataaattcctaaaagtgacgccactggattggaggtcatttttttttaaactttttattttgaaataattatagattcataagaagttgcaaaaacaggacagagaggccccagttgcccttcacctagtttctcccaatgatagcatcttacataacatgatacagcatggtatatcatatcaaaaccagcacattggtacaatctacaaaccttattcagatttcaccagttttacatgcccttgtgtgcatgtgtgtctgtgtctttgtggttttatgtgcttttatcaggagtagatttgtataacctcaaacaagatgcagaactgttctgtcagcacaaagatcccttgtgctacctcatagtcacaccaaacctcctctcctccttttgtcatcacggcattcctaactgttgacaagcagctaatctgttctccatctctgtaactttgttattttgagaatataattgaaatcgtatagcatggtaaccattgagatgggtttttt

SEQ ID NO: 84543 - DNA, 505 bp, Homo sapiens
cctagccaaatctggattccaggcatttgcaaaacaaataatgatattaccacaattgccatgattacgatgtaaccatgatttgtgaccatgaagcacccataaatttaactgacctacattgtgactgagcccacagcctaacattatcctttaagtaactgagtttaccacctcatgccatctagtaggcaattatcagttttgctcacttgcccctttattatatgatgtgtatttccttatacctgtgcttcattaatatagccaacattcactgaatacctactctgtgccaggcactgttaatacagaaatgaataaggtaccccatttgataggggagatggatatcaacaaaatttacaagtaccacaacctgtaaccctcatgctctaggcggatgttattgataaagtggctcatccatgtcatcaccaggtaactaagctggtgactttagcctaggccttctaagcagtgtagctcctctgtacccctccta

SEQ ID NO: 84544 - DNA, 800 bp, Homo sapiens
tggcagggccatggcggaggcccgagtctcccagcctggggcatctccacgctctgtaacgctgagctccaggcacccgtgaagccccacgggtcaaggctggtgggccggggctgggaggcctgcacgcctgggttctgggtccctaaaccagtacccatccaccacagccaccatgatctggcttcgaaacaggaggtgccttgagccgctccagggcaccccgaagtgggtccctgttctgggggagctgcaaaagaccctccagaagggcgagtacctgcccctccgtccgctgcccatgttcgagagtaactttgttcaggtgacccatcaagggggcccagtgttcgtgaatcacagaaccaaccggctggccatgggcgtggccgcctccctgccaggcctggtgttgcctgacatcttgctgatcggccagcccgccgaggacagggactgctccggcctcgtgctgaccaggatgatcccctggacctcgtccacctctgcgtccatgacctctctgcctggcgcctgaagctgcgcctggtctcgggccgccagtactacctggccctggacgcccctgacaacgaggtgggcttcctgttccactgctgggtccgcctcatcaacctgcttcaggagccggctcccacctggacccccaggaccacgcgcacggcccccctggatatgccgctggccgaagcgcctgcctccacctggcacctgcaggaccagcccatcagcagacatgcagtcagggtttgctgagcgcaactttccgcatagacggg

SEQ ID NO: 84545 - DNA, 291 bp, Homo sapiens
tcatctttgttagatcggtgttcccaagtatcttactgaccaagagacgtccttaccaagaacatgagttaaatcatgttcacttaactctgctaattcagtgtaatttatttctaatatgttaatacgcaaaatattttcaaacatatacatcttcatgatacttaaatcttttaaaatttccaaccagaggccgggcgcagtggctcacgcctgtaatcccagcactttgggaggctgaggcgggcggatcacaaggtcaggagatcgagaccatcctggctaacacgg

SEQ ID NO: 84546 - DNA, 364 bp, Homo sapiens
ctgtgctggatacaacttagaaagacagactcagaaattgccattgccaggttgtctacctcctgttcactgacatttagcctgtgcatggtctcaattcttttctgtctgcaggctcttagatcatttagctctaagagatgggagttgaaacatgtctgcttgaagtggaccagttcccttctctatatgtaccaggaccaaattatggaataggttgtgttggagaagttgaaggtggaaactggaatgggcaagagtaggcagtgatagggacggtacttagaacgttggagaagtaagggaaaggagaggaatgagtgagccaaccacgttccatctctcttgcccttagaaccataca

SEQ ID NO: 84547 - DNA, 209 bp, Homo sapiens
tctttcttttcttatctatcttcttcaccatgtgtcttcggggcctggaacatagtagatgctcaataaatattgattgaatgaatgaatgaataaatctgcttacacctctcatgcttcaaacagggaaaggctagattatttagaagtcttgtcggggataataatgagctcagtgaagccctctagttctcactcgagtttctccc

SEQ ID NO: 84548 - DNA, 370 bp, Homo sapiens
ataagagacaaggtcaaaaggaaaatgtctttacatatgaagccttccatttacagcttaactatccctggaggccacatctaaggacaacccttttaaaaagccatggtgtgtaaatgaatatgtattttgtgtatattcagtatattcaaggtaaatagttgtttttattaaaataacaagggaaaaatagtggaccttcctcgctcatgaagaacatgagaggatgaactgtttaggtcaaattttaaaagaccaggctgggtgcggtggctcacacctgtaattccaacactttgggaggccaaggcaggcagaccacctgaggttgggagtttgagaccagcctgaccaacatggagaaaccctg

SEQ ID NO: 84549 - DNA, 488 bp, Homo sapiens
cttattccttttggacagaatcccaattagtctagatatttttaggcgaagatagcttcatctcaggaaaggtcagatcggttcctgattaggaatgggcatgtgtattaggccttttgcattgctgtaaagaaacacctgaggctgggtaatttatagggaaaagaggcttaattggcttacagttctgcaggctgtacaagcatggctccagcatctgcttctggtgagggcctcaggaagcttccgatcatggtggaaggcaaagggggagcaggcagtgtcccatggtgaaagcaggaacaagagagagaaggggaggagccgggctcctttaaacaactggctgtcttgtgaactaacagagccagggctcactcagagattaccacagagagggcaccaagccattcacgagggatctgccgccatgatccagtacctcccaccagccccacctcctacactggaggtcacatttcaacctg

SEQ ID NO: 84550 - DNA, 450 bp, Homo sapiens
cttgcgggaggccgtgctgctggcaaggacatgcctaaagccagctttggagatggcggttccagctgtgcctgcatgcactcagacacactgagcctgaagaaggcgggcactcacggtccttccaggagtttggggtgtggaactggaggcactccccatccccagcagtaccacctggctctgcttcagtttcctcggatggaggatgtgactacacttcctccaggcagctctgccacgctcagctcctcctcctcatcctcagctgaggcagatgaaagccaagtgccatctcccacctgggagcggggtcggccacaggcctggtgctgggcagtgaggtggctgcctgctttcctattacattttgcatgttccatcattttaaaagaaacccttggatgagtgagctttgccccgtcagctgactctcgttactgagaacag

SEQ ID NO: 84551 - DNA, 861 bp, Homo sapiens
tgctcagtggaagctggttctgaacaatgttaactgccccacccgtgtccatgaagggcagtggaagagcaaggggcggtttaattacctgggatgtaaaacagcaggcacccccactgccctcctcagctgttggggtggcagggtggagttgagggcctcactcgttttcacctttgcacaatcagtcacacatttgttatatgacagctatgtgccacacacccatgttcagtaaggtggaagccagctgcaggcgtggtccacagttccagacatctctgaaggatgtgacaccaactttcaggcagaacatttagaaagagtgaaataaagtgaaacagatcaaccagcctattgagtatctacgtgttttttttacaggcaagaactgaggaggcaatactatttagaatccttgataaacagttccaaaagaaaaaaaaaaacaggctttggtgactctcatgggccctccgtgccaagagtctatggctctgtgatatattaaatcaggcttgttaattatttaatctaacagctgccatgcaccctcattttaaaaacagatgaggcaatgtttacattttctccatgtcctccatttggaagtgtcttagtttgttttgtgttgctgtaacagaataccacagactgggcgatttatagacaatagaaattaatctggctcatggttctagaggctaggaagtccaagagcttggcactggcctctggtgagggccttcatgctgtgtcattgtgggcaaaagagcaaaacttgctttgataaaatcactcttggcaataactgaccctcctctcataataacattaattcattcatgacagcagaaccct

SEQ ID NO: 84552 - DNA, 3336 bp, Homo sapiens
ggcctggaaagtgggagatttcattcgcccgggttaaaaatccagaggaagacagaagagaggagtcctaggaactgagcagattttagagacgcaaatgatgtttaagagagccttgtgatttgtagcaagcatgggcactgctttttcttactaatgtggtagatctacacgaacattctaggctgttctgctcagagcgaggaaccactgctcctcaatggggagggaacataccacccagccaggcttagcgttgggttttatcctttaataaaagttttataatgattcctgttcaccttaaagtgtgattatggagatgattggctccatatttcaccacgtcattccttcaactcaccagacacctttctttagttgaaataaaccagcatgacctggagatcatggtgactgtaagctaagtctgttttcatgccagatttcagccccacccagagtgtgctctagatgttgttgatttgaatggttttcccagttcccactccacatggggaagttgaatgaatgcacacctgctgctcacttcttgtgaggctgccttttgtgatcaaataacaggaagttctgctttagaggagggcacgatgaccatgtggcagtctgcaagtggaattttgggatggcagcccgaggaacatccagagttactgtgtgacttggtcctgccattgttagctttgaaatcacaggcattgggctctgttttgacaccattcattggactgcgggacagtcattctttacgttctctcttgagctggtgagagaggaggaagagggaagtcaagagcaacctccaaggcctatgtcagcctcttctccttgggtcttggggtgggttagaactgggttccagtctggccagatgggttgctggctgcactgagggtgattcttctcagaagatgggctgcctgtggtcaggacagggcataccagtctggactccaccttcccagacacctactttaaggacctgtggaaactgggtgatccaattatagggctggggcaaccctgctttggccaccctcatttacaaacttaggttgggagcttgggtttcctgtctcacttccaaaagccttcaagatggcagcagatggacacaccctctcatttcttgtgtcttgtctgtcagatggcaggaggcctgtatcagtaaatttgaggaaaatgttctctcctgggccagcctcacagcttgcgttgggtgtgttggaattgttctcttcggccttgttctgccttgtgatcttttcaattcagtgaataaaccaggtatccattttttcaccaacccaccctgtagattgtcagctttttgtttgagagatgcctggtctcacagttacatgtatcagagtgtgtgtaagttgtctgtgttagaaaggttggggtgggggctttgttgcaggggattagactgttctttcttcatcataatttgagatacatcctgagtatgactgtctaaccctttctgtgtggcagaaaaatatgttttccaggtagtttttactactacagagagtctgtaaataagtgctttaaaaaaataacaaaccaataagatatttgtctcctatataaacattctgtgtatttagcacttgaaaatcaacaaatccagaatttaaaaaaatgccacagacttttcaaagcccaactgtacttttttgagaatttgtccgtacctactaatatgccttattcttcttcacctagtgttttaaaagtcctgggtagaaagagttttagaaatgtaatcagttgttcagcttcaataatatagagatctaacatagtcagtcctcaggccccctaaagaaacaagcaagaaagtgagggccatcactagggttggctttggggaggggaaaactaaggactgcttttgccaaatgatatttttgataatgtaaggaaacacagggaccacaaaacctttttttttttttaagtgtgaaagattagtgccttttggcatacttttgattttagaggatatagtatcggcattgacaaatcacgtagaaacaaagaatgctatagatgacaacagtattaaatgttactcctgattctgcagaacagcttttgaagatactggggggtatcttcaagcctcagagcagcttgtttcagatagaaattctctatgggttgaaatgccaaaaacagaaaacatgatgttgactcatgtaatttagtccattttagcagagcctttagtgttaacaccagtggcgaggagcattgcatattctctgtcagcagcagcactcccacaccaggtggttctgggctctctgtaggctggtcctagtaggtgacacccagcaacacccctgttggacaggattgattgttcgcagtcttagaccaacacttcagtcagaaatgttactgggaggaggaaaggaaaatcactttttttcctccatgtggaaatgaggagagaggaaagtggattgcaaaccaaaatgtgagtcagtgtgatgaagcagtggctctgtcatctcggcctttatccaataacaaaccagcatctcttaaaggcgcttttggcctagacacccctgaagtttggatgaagtctggtggattccctgtccgttgtatttctgtgtgcctgttcccttcattgctgtgagttgggagtgcattgagagatgatgtccatctgatatattcctgtgaaataaactgccagcaaactttctaacttgtattttaactgttaaagaagagattaaaaacttcggctttggacatgtccacattatggactgtcatcttatttttaaaagtcattctttacgtttaaaattttaaaataaaaaccttctgaggtattgatgtagtccaccgtgtaaatgttaccttctctccatgctgccattatgccaaaacaaaagctgtgataaaaaaagtgcttgagagagtgtgttgataagaaagtgatttatttacagatggaagtctttgtttcatgaagctaccaaactttaaaaagaatgtcacccttttttttgtttgttatggaaaccagagattgtaaaatggaaaaagaatcgttttttttgttgactttttgatgctggcacgaggtttttgtccacttttttcatatatctgtgtataaaaaaattgttgtttactatggaattagtattacattttgaggtaaacaaaagaatttgtattgcttgataaatattagcttgtaaatttaaagtttctttacttcaattaacttaaaggaccaataaacccataaaagatgctttctttaaaaaaaaaaat

SEQ ID NO: 84553 - DNA, 3282 bp, Homo sapiens
ggcctggaaagtgggagatttcattcgcccgggttaaaaatccagaggaagacagaagagaggagtcctaggaactgagcagattttagagacgcaaatgatgtttaagagagccttgtgatttgtagcaagcatgggcactgctttttcttactaatgtggtagatctacacgaacattctaggctgttctgctcagagcgaggaaccactgctcctcaatggggagggaacataccacccagccaggcttagcgttgggttttatcctttaataaaagttttataatgattcctgttcaccttaaagtgtgattatggagatgattggctccatatttcaccacgtcattccttcaactcaccagacacctttctttagttgaaataaaccagcatgacctggagatcatggtgactgtaagctaagtctgttttcatgccagatttcagccccacccagagtgtgctctagatgttgttgatttgaatggttttcccagttcccactccacatggggaagttgaatgaatgcacacctgctgctcacttcttgtgaggctgccttttgtgatcaaataacaggaagttctgctttagaggagggcacgatgaccatgtggcagtctgcaagtggaattttgggatggcagcccgaggaacatccagagttactgtgtgacttggtcctgccattgttagctttgaaatcacaggcattgggctctgttttgacaccattcattggactgcgggacagtcattctttacgttctctcttgagctggtgagagaggaggaagagggaagtcaagagcaacctccaaggcctatgtcagcctcttctccttgggtcttggggtgggttagaactgggttccagtctggccagatgggttgctggctgcactgagggtgattcttctcagaagatgggctgcctgtggtcaggacagggcataccagtctggactccaccttcccagacacctactttaaggacctgtggaaactgggtgatccaattatagggctggggcaaccctgctttggccaccctcatttacaaacttaggttgggagcttgggtttcctgtctcacttccaaaagccttcaagatggcagcagatggacacaccctctcatttcttgtgtcttgtctgtcagatggcaggaggcctgtatcagtaaatttgaggaaaatgttctctcctgggccagcctcacagcttgcgttgggtgtgttggaattgttctcttcggccttgttctgccttgtgatcttttcaattcagtgaataaaccaggtatccattttttcaccaacccaccctgtagattgtcagctttttgtttgagagatgcctggtctcacagttacatgtatcagagtgtgtgtaagttgtctgtgttagaaaggttggggtgggggctttgttgcaggggattagactgttctttcttcatcataatttgagatacatcctgagtatgactgtctaaccctttctgtgtggcagaaaaatatgttttccaggtagtttttactactacagagagtctgtaaataagtgctttaaaaaaataacaaaccaataagatatttgtctcctatataaacattctgtgtatttagcacttgaaaatcaacaaatccagaatttaaaaaaatgccacagacttttcaaagcccaactgtacttttttgagaatttgtccgtacctactaatatgccttattcttcttcacctagtgttttaaaagtcctgggtagaaagagttttagaaatgtaatcagttgttcagcttcaataatatagagatctaacatagtcagtcctcaggccccctaaagaaacaagcaagaaagtgagggccatcactagggttggctttggggaggggaggaccacaaaacctttttttttttttaagtgtgaaagattagtgccttttggcatacttttgattttagaggatatagtatcggcattgacaaatcacgtagaaacaaagaatgctatagatgacaacagtattaaatgttactcctgattctgcagaacagcttttgaagatactggggggtatcttcaagcctcagagcagcttgtttcagatagaaattctctatgggttgaaatgccaaaaacagaaaacatgatgttgactcatgtaatttagtccattttagcagagcctttagtgttaacaccagtggcgaggagcattgcatattctctgtcagcagcagcactcccacaccaggtggttctgggctctctgtaggctggtcctagtaggtgacacccagcaacacccctgttggacaggattgattgttcgcagtcttagaccaacacttcagtcagaaatgttactgggaggaggaaaggaaaatcactttttttcctccatgtggaaatgaggagagaggaaagtggattgcaaaccaaaatgtgagtcagtgtgatgaagcagtggctctgtcatctcggcctttatccaataacaaaccagcatctcttaaaggcgcttttggcctagacacccctgaagtttggatgaagtctggtggattccctgtccgttgtatttctgtgtgcctgttcccttcattgctgtgagttgggagtgcattgagagatgatgtccatctgatatattcctgtgaaataaactgccagcaaactttctaacttgtattttaactgttaaagaagagattaaaaacttcggctttggacatgtccacattatggactgtcatcttatttttaaaagtcattctttacgtttaaaattttaaaataaaaaccttctgaggtattgatgtagtccaccgtgtaaatgttaccttctctccatgctgccattatgccaaaacaaaagctgtgataaaaaaagtgcttgagagagtgtgttgataagaaagtgatttatttacagatggaagtctttgtttcatgaagctaccaaactttaaaaagaatgtcacccttttttttgtttgttatggaaaccagagattgtaaaatggaaaaagaatcgttttttttgttgactttttgatgctggcacgaggtttttgtccacttttttcatatatctgtgtataaaaaaattgttgtttactatggaattagtattacattttgaggtaaacaaaagaatttgtattgcttgataaatattagcttgtaaatttaaagtttctttacttcaattaacttaaaggaccaataaacccataaaagatgctttctttaaaaaaaaaaat

SEQ ID NO: 84554 - DNA, 2992 bp, Homo sapiens
ggcctggaaagtgggagatttcattcgcccgggttaaaaatccagaggaagacagaagagaggagtcctaggaactgagcagattttagagacgcaaatgatgtttaagagagccttgtgatttgtagcaagcatgggcactgctttttcttactaatgtggtagatctacacgaacattctaggctgttctgctcagagcgaggaaccactgctcctcaatggggagggaacataccacccagccaggcttagcgttgggttttatcctttaataaaagttttataatgattcctgttcaccttaaagtgtgattatggagatgattggctccatatttcaccacgtcattccttcaactcaccagacacctttctttagttgaaataaaccagcatgacctggagatcatggtgactgtaagctaagtctgttttcatgccagatttcagccccacccagagtgtgctctagatgttgttgatttgaatggttttcccagttcccactccacatggggaagttgaatgaatgcacacctgctgctcacttcttgtgaggctgccttttgtgatcaaataacaggaagttctgctttagaggagggcacgatgaccatgtggcagtctgcaagtggaattttgggatggcagcccgaggaacatccagagttactgtgtgacttggtcctgccattgttagctttgaaatcacaggcattgggctctgttttgacaccattcattggactgcgggacagtcattctttacgttctctcttgagctggtgagagaggaggaagagggaagtcaagagcaacctccaaggcctatgtcagcctcttctccttgggtcttggggtgggttagaactgggttccagtctggccagatgggttgctggctgcactgagggtgattcttctcagaagatgggctgcctgtggtcaggacagggcataccagtctggactccaccttcccagacacctactttaaggacctgtggaaactgggtgatccaattatagggctggggcaaccctgctttggccaccctcatttacaaacttaggttgggagcttgggtttcctgtctcacttccaaaagccttcaagatggcagcagatggacacaccctctcatttcttgtgtcttgtctgtcagatggcaggaggcctgtatcagtaaatttgaggaaaatgttctctcctgggccagcctcacagcttgcgttgggtgtgttggaattgttctcttcggccttgttctgccttgtgatcttttcaattcagtgaataaaccaggtatccattttttcaccaacccaccctgtagattgtcagctttttgtttgagagatgcctggtctcacagttacatgtatcagagtgtgtgtaagttgtctgtgttagaaaggttggggtgggggctttgttgcaggggattagactgttctttcttcatcataatttgagatacatcctgagtatgactgtctaaccctttctgtgtggcagaaaaatatgttttccaggtagtttttactactacagagagtctgtaaataagtgctttaaaaaaataacaaaccaataagatatttgtctcctatataaacattctgtgtatttagcacttgaaaatcaacaaatccagaatttaaaaaaatgccacagacttttcaaagcccaactgtacttttttgagaatttgtccgtacctactaatatgccttattcttcttcacctagtgttttaaaagtcctgggtagaaagagttttagaaatgtaatcagttgttcagcttcaataatatagagatctaacatagtcagtcctcaggccccctaaagaaacaagcaagaaagtgagggccatcactagggttggctttggggaggggaaaactaaggactgcttttgccaaatgatatttttgataatgtaaggaaacacagggaccacaaaacctttttttttttttaagtgtgaaagattagtgccttttggcatacttttgattttagaggatatagtatcggcattgacaaatcacgtagaaacaaagaatgctatagatgacaacagtattaaatgttactcctgattctgcagaacagcttttgaagatactggggggtatcttcaagcctcagagcagcttgtttcagatagaaattctctatgggttgaaatgccaaaaacagaaaacatgatgttgactcatgtaatttagtccattttagcagagcctttagtgttaacaccagtggcgaggagcattgcatattctctgtcagcagcagcactcccacaccaggtggttctgggctctctgtaggctggtcctagtaggtgacacccagcaacacccctgttggacaggattgattgttcgcagtcttagaccaacacttcagtcagaaatgttactgggaggaggaaaggaaaatcactttttttcctccatgtggaaatgaggagagaggaaagtggattgcaaaccaaaatgtgagtcagtgtgatgaagcagtggctctgtcatctcggcctttatccaataacaaaccagcatctcttaaaggcgcttttggcctagacacccctgaagtttggatgaagtctggtggattccctgtccgttgtatttctgtgtgccgggtccggaccccggcaacacagagtacaagagactggcaggagagaagagaggagaaacagagaaggagagagaaagggagagacagaaggagagaatgaacggtggcaagctagaaatctagaaggaaagcaatacaaggagagggagaaagacagaaagcagaaaaaagaaaagagaaggaagggaaaggaagaggaaagggggaaaaggcaagacaagagagggtaaaaggaagagacagagggagagagagaatgacagtggtgtataatttattcccttctgtgattcaagactcagtctccagccacaaaaaggatctaaaa

SEQ ID NO: 84555 - DNA, 123 bp, Homo sapiens
agaataaatggctgcaagcatgaaagacaagctctatatactaaacaaaaagttgatctaatttaatggtgtcataattttaaaaattgtgttgattgcaaatttttttttttttttttttga

SEQ ID NO: 84556 - DNA, 724 bp, Homo sapiens
gaaatctcgttgagtttgggaggccttacttctgcatatttgaatctggtgaccaaattaaacattgttctaactgtagtggtctgatcattctaccaaggccatgactgtgaagagcactgtgggtgatggctggtggctcaccggagccggcttgtgcacggcgcccgaagccaaagaaatctgaagacccgaccttactattggcaaagacagacaaacactctacaaatagtgcttgaaaaatgccactgtttggttcagatggtgaagaggaactcaggaaggcctggcagtctctaggaggctagggcagtggttctcaaatgatagggtgtacagaaattccctggaggacttgtgacaacaaagattgctaggcctactcccagggtttctaattcagcaggtctggggatggagctcaagtatctgcatttctaacaagtccccggtggtgctgatgctgcttgcatggaccagttttgagaaccatacttggagaaacacttggttaggaaaactatgtctgttacagattgatcaaagggctcttaagttccttttgtacaataaatcactgcgatatcaaatgaggtaaatgaacatgctctttgaactcttaacttctagaccaatataaaacattctaaatatgaaatggaaacatttacaattgttattgattctcatcaatgcaatgttcaataaagataagaatcac

SEQ ID NO: 84557 - DNA, 444 bp, Homo sapiens
  misc_feature (333)..(333): n is a, c, g, or t
ctacagtacccatctccattttcagagagctccgatggaaatttctatgaactaattctcctgcacatactttggtacaagtgggctactggagccaccttccttcgttcaatcaaacagcatttattcagcttatttaatgaacactatccaagatacttgggggacagaaatgaaaagatggggagacctgtcaaacatatggtactatgtctatgcaaaataacattggaatgtagattcacagtggaaggcagggcaggcatggaagaattctgagaatgagtgtgacagctcctacctgtaacagctcttcaagctcctgctggaagnggtcagtcagcaaatctactagctggctcgggcaaagtccgcccggctggaggaaagtgaattccgggatttacagagcaggtagagggcatgcggcccagccctcaagca

SEQ ID NO: 84558 - DNA, 417 bp, Homo sapiens
tcaaaactgggcaaagtgcacacttcagtagcacatatactaaaaatggaacaacacagattattagcatggcccctggaaaaaaaaatttaatgggcaaagcacttgaatagacatatctaagatgtacaaatggccaataagcagatgaaaagatgctccacatcattagtcattaggaaaatgcaaaccaaaaccacaatgagaatgaccatatgattcagcaattccacttctgcgtgtataccccaaagaatcgaaagcagggtccggaagagctgtggacaccatgttaacagcagcattattcacaatagctaagaggtggaagtaacccaagaatctataaagggatgaaaggataagcaaaatgtggaacatacatacacttaaattttattcagccttaaaaaggaa

SEQ ID NO: 84559 - DNA, 744 bp, Homo sapiens
ccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtgttt

SEQ ID NO: 84560 - DNA, 159 bp, Homo sapiens
ccacgtaacattttggacaacaacggactgcatatacaacagtggtcccataaaattatcatgaagctaaaaaaaactcctccaggctggctatagtggctcacacctgtgaccctgtaacgctgggagtcctgagctcagaagctcgagaccagcctg

SEQ ID NO: 84561 - DNA, 284 bp, Homo sapiens
acatatacatatacatattatacatatgcatacatgtaatttcttagctacatctctaatgattagatagataggggaaagaatccattctgagaaagaaaatggtactattgggtgatgagcagagtcctcagagaataaaataaaacagttcatttctgtttctatcaagtcgtttatcaattcccactatatctgtcttcaaagtgcttttttgcccgttatttcccccagggtcctggctctcagacaagaagagaggatagcactggaacctctagatc

SEQ ID NO: 84562 - DNA, 192 bp, Homo sapiens
tccatggtactcttcccgctaatgcggggcaccttcctaatactcggctctgtgcatttcactcgcagctgacacacttcagtggccccaattttcatggaatatttaaagacgggctctggtgggtaatcaaggaaagaccaggcaactcaggagggcctgaaaggtgcacgattctcagccaggtgtgga

SEQ ID NO: 84563 - DNA, 826 bp, Homo sapiens
ggaggatcggtgtgaaataacgggcccatataaatccctctgccgcccgcctgcaagatggattggccgcattgaaattcctccgcgaggataattaaactcggggcctcatccgggcaaaattacattcctgtaatggcgtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagag

SEQ ID NO: 84564 - DNA, 499 bp, Homo sapiens
gacgcctgcttatctcaaaggtgggttgtggggatccacatgaaacaaggaatagcctctcatggtcagaggtcaatggatgctgccgttctgagggtggctgccaccacctgatgcagggtgcggcttccaccatacccaggagcagctggccttggaagtgagccatgtgacctgccttccgggcagacccctagcggagctgagcatggtggtggggtgtcagcagggtgtctgctttgccaagtcctttgcggacctgccctgagttcctccactcttcctggccaggggactccaagcgtgtgggcgttgtcagtaagtgtcaagcctgtgggcgttgtcactaagtgtctgcaaacatctgtgattcctcccagacacatcgctggctggagaggggacgtcgctcgagacgtctgcagggtgaggcagcctcgctggcaaggggcctgatgggcagccctgcgtggaagatgtccccagggaggacacagca

SEQ ID NO: 84565 - DNA, 436 bp, Homo sapiens
ccagggatccttaatggctaggggtatgtcttagaacttgagacagcaatgagttcagaaggcttagctccagggagaggagggatacatatgttcaggagcaatgaggccattgtacacctcaacagaaaactaccattttaccatttgtcctttggtttccctaaggcatggtctggagattcttcactgacaatcactagcactggaatagcaaagtcacagtgattcaggattagcaatagtcatgggacgtgaaatacaaaagtaaaaaaggattgactaggcaaataccataagccaaagactaaggagttgttattatatggtcaggtatatgtgaatgtcaggtggccagcaggaaaggtgcagaaagtggtttctaaacagacgggaaattctcagtgtgcagataatctgtcaaacctagagggaa

SEQ ID NO: 84566 - DNA, 734 bp, Homo sapiens
ccggagccaggagccgcaaccaattcaggtctgccttgggggtgttcagtgttttttattttgctcatcacagtgaattttaagactgctcagtgtttgggtctgcactgcgtttatgagctataacacttactgcaaaggtctgcagttttactgctgaagccagtgagaccaggaacccaccttaaggaagaaactccagacccatctgaacatctgaaagaacaaattctggacacaccatctttaagaactgtaatcctaactgcaaaggtgcgtggcttcattcttgaagtcagtgaaaccaagaacccaccaattccggacacaccagcacattgggagaccgaggcaggcagaacacctgagatcgggagttttgagaccaacctgatcaacatggagaaaccccgtctctactaaaaatacaaaattagctgagtgtggtggcacatgcctgtaatccagctactctggaggctgatggaggagaatcgcttgaacctaggaggcagaggtggcagtgagccgagatcgtgccattgcactccagcctgggaaatgagagaaactccgtctcaaaaaaataaataaattgattgtgatgtcatgaaggtgcaaagacagttaaagattactgatattgttacaacactgtgttgattgtagtagtgggagaaaatactgttttctgattagtttatcagatatagctcattatatatgtggtgaga

SEQ ID NO: 84567 - DNA, 1089 bp, Homo sapiens
  misc_feature (1)..(2): n is a, c, g, or t
  misc_feature (4)..(4): n is a, c, g, or t
  misc_feature (388)..(388): n is a, c, g, or t
  misc_feature (405)..(405): n is a, c, g, or t
  misc_feature (416)..(418): n is a, c, g, or t
  misc_feature (426)..(427): n is a, c, g, or t
  misc_feature (454)..(457): n is a, c, g, or t
  misc_feature (474)..(474): n is a, c, g, or t
  misc_feature (498)..(498): n is a, c, g, or t
  misc_feature (965)..(965): n is a, c, g, or t
  misc_feature (1086)..(1087): n is a, c, g, or t
  misc_feature (1089)..(1089): n is a, c, g, or t
nncnggccgtcggtaacagaaaactcagtgcatactttgctgttgttaggttgtcaatatagtctttctgtaggatggatagcatgtttgagaggtgccaaacaagaacttttggggttagtagtgtgtcttgtggagggtattacaggactgtgtaattataggactctaacttgacatggcttggcacccacttgcagctagtgggtacagggtacaaaagatgttagagaaaagctctacagattacgtacttctgtgtcttcgtatgctcaacactgtcctttgtcctccatgaaagatgaaggaagcaaattatgtatgtactttctttgaccttctttaatctctgatactttttagattgcatgattttactaggcttgtntttagggaaattacttncataaatactnnngtagattnngaatcaaaactcagtctttttaatttnnnngtagtctataaactagnttcattatgatggacttgattagnccaaagttaattttagaaattgtcaggtagcatagtgtcttcccatgatcaggaggctttctgaaggactgagtctgtaaatgaaaaaataatttatgtatgaatagcatgtatttctgaagagcttagagtgccttgtagaatttttttctcaattttattcttgaggtttataatttgggggccaaatagatagagctcatcattttcttgtttggaagttgaggctgcgacatgtccaaggttatgaagtctcttttgggaagaacagaaaccaggtctccaaatctggactcatggtttgttcagatgtgtctggacaaatggttgtcaatgttttgtcctgttttttcaaaggaactgttcttcctttgggacaaccttttggtgtttgggaaagtaataagatcttggatttttcaaattaacattaagttgtaagaactaaaattttctttgaaccacantactgtgtaattcactgataattgacatattggctgggcagcctatctcttccatatccagcgtaaatgaataggaggtgtttgtgattttttttttctccctttatttaacattgagtcnnan

SEQ ID NO: 84568 - DNA, 490 bp, Homo sapiens
agaagaagacataagtctctcataaaataagagtttttaaaagttgctgatattaactttctaattgtttacatttcagctaagttagagtttactataataaaaatttaaaacaaggtcaatatctctaaaaaagtaaaagttctgactaaatacttttgcatggatgtctgaataagtattcatacagtgccttttctaagcactggatagcagtaaacacaaaagacagaaatcccttcctttagggaaattacacctcagtaaggaagatagacccaaacaaagaaacaaacaaaaaagtaaattatgtttatatgagaaggtgacaaatgcagtgaaggaaaactaagcagagaagggggatagaaagagcaggaaaacagtaaagtggaattacaactttaaatacggagatccagaaagatctcaaaaaaaaaaaactctatgcataagtatatgccttagtttttttagcttaaatcataaa

SEQ ID NO: 84569 - DNA, 448 bp, Homo sapiens
gccattactgcttagtctgtaatgaaagctttactgcttctatgctgtgctcaagagaaaaccaacaacggaagcgaagacttacttgctccttcacagaattgcagcaaagctctctgctgggcaatggtgacaggaaagtgtgtaattgacttgttgaagataatcatgagaccatcttaacattacttgccttataagttagaaatagtatggatatcactctttgtaaataataatttttgtaaatgttttttgttcataattttcccaatcacctatttcacaaaatcctgaatatgcaattatttattatgacacgttactgcaactagggctcccattccagaacaaagtttaattctatatgtaagttgttactgaaatgtgatttctttttctggaaaataaatgaaaaatatgaaaataaattgaattgtgaatatca

SEQ ID NO: 84570 - DNA, 490 bp, Homo sapiens
ctaaaatggaataaaatacataaaacccaaatattaaatcattgagagaaatttttaaaatagtcttagattccttctttttaatgattccttgatgggtgggtgaggtggcacacacctgtaatcccagcactttaggacgccaaggcgggtggctcacttgaggccaggagttagagatcagcatggccaacttgccgaaaccccgtctctactaaagatgcaaaaattaaccaggcgtgctcatgcgaggctgtaaccccagctactcagggaggctgaggtgggagaattgcttgaacccaggaggcggaggctgcagtgagtcgaggttgtgccactgcactccagcctggacgacagagcaagactctgtctcaaaacaacaacaacaacaaaataataataattataattctacgacagccatttcatgaaaaaatagaatttatcttcccgtaatacacattactgtcaataaacattccca

SEQ ID NO: 84571 - DNA, 451 bp, Homo sapiens
tgtgtatatatagtgtgtatatagtgtatatagtgtgtgtatatatatattgtgtgtatatatatcgtgtggatatatattgtgtggatatatatatagtgtatatatattgtggacatatgtatagtgtgtatatatattgtggacatatatagtgtatatatattttggacatatatagtgtatatatattgtggatatatatatagtgtgtatatatattgtggatatatatatagcgggtatatgtagtggatatatatagtatatatatattgtggatatacacacacacacaatagctgggcattgtagtgcatgcttgtagtcccagttactcaggaggctgaggtagaaggataacctgagcccagggagattgaggctgcagtgagccgtgatcagtcgctccattgccctccagcctgggcgacagagaccctgtctccaa

SEQ ID NO: 84572 - DNA, 339 bp, Homo sapiens
ttttgctttccagttgtgattatctataccaatcgaaacttgtactggtgcttttatttagatcctactcccaagtatgtatttatttttaaaaatttatgtaagctatattttttttggctataataactttcctaataattcttttagataggatttgagagtgatatactttctgtattgttacatatcagaaaatatatttattttgcccctgtacatgattagtttaactgggaatgaattctgtgttcctaatcatttcccctcagattttcaaaaaaaattgcttcattgtttccaatgaaatatctgacatcaaataattttttctttgcg

SEQ ID NO: 84573 - DNA, 350 bp, Homo sapiens
ggggaaaagaggagggttgtttcaaatgcacagtttcagttttgcaagggaagggttatggaagtggatggtgctgatggtggcacaacattgtgaatgtacctaatgcttctgaaatgtatgcttaaaaatggttaagatggtagtttatgttacgtgtattttactatagtgaaaaaaaagtatgttcgagtatgtttcagaaatactggcttagagcaaatttcgaccacactctgtgaactggaggacacccctgtgcaaccaacatgccagtctgtactctttaaaaggagccattgctgactttccttggacctagtgtcctctttctttctctctctctctct

SEQ ID NO: 84574 - DNA, 331 bp, Homo sapiens
aaaatttagttttcctcatacagatactgtacacaattttgctacatttgtacttaagtatttcattcttgaagtgctgagtaagtgctattgtgttttttgaatcaaatccaattgttcattgctggtataaacaaaagcgactggcttttgtatattgaccttaaattctccaataacttattagttcaattttttgctacaattattagtttaattatttgctacaatttttgttgattctttgggatttcccacattaaaattatgtaatctgtgaacaaagttttattttttctacccaatttgtgtgcatctccttccttttttg

SEQ ID NO: 84575 - DNA, 377 bp, Homo sapiens
gagtttagacctcagtggaattgactcatgtgaaatgagtgatagtggaagtcaagtgccagacagtctgcctagcacaccatccccagtagagtctactaaatcgttttctgtgcactctgacagagaaagcagcatcacaaatgatatgggctttagtgatgacttctctttacttgaaagccaagagagatgtgaggaggagcttcttcaattactgacacatattttgaattatgtaatgtgtaagggactagaaaagtctgatgatgatacttggattgaacgaggacaagtgttttcagcactaagtaaaccaggaatatccagtgaactacttcgaccatcagatgaaataaaactaacgtaagcattta

SEQ ID NO: 84576 - DNA, 879 bp, Homo sapiens
ctactgctgctagcaaataaccagcaaaatgtagaaaatgaaaaaccaattttctgtagacaacctggagaaaagagtgcctgcccctgacttagcggggcagagaatgacaatttttaaagtttgccttttctgaaggttgcttttagcccagtgctgcctcagcagcaaggggcaagcagagtcattgcgcatgtggcgcttccagctctacctgtggagctggcctgggctcagataatcccctgtgactggccattggagcggcggagctcctgaggctagttcacagcacccagaggtctcttacagtcaacagattgcatactgttgacagactgcaatccgtctgtgttccccacaccaactccatttccaagatgggaattttattcaggaactcatttttgagttcccaacatgttgacttcgcatccatttctgctcaccaaggcagaaccatagcagtggtgtgtgacaaagatgcaaatggagggcagcccaaacaatggaaaagagaagattttcagcccattcttggggctaagtgaggttttgatttatggtagaagacagttctaaaaagcagctggcagcatgggcttcaatttgtggcccttctgagttcaaacagaaggaaggaaaaggagccacataaagtgtacacattcaattcatcttagaatgatagctcccaccttattacactgtacaactatttaataatctgggttacacacatccagaggtgaaataaagaaattttcacttacaaatgtgtatttccaacatgctaagttaacctccagagagaagtgcctgtaatctctgttcctggtgtcactttaaagcttttgcttcatgactgtagctgttgtt

SEQ ID NO: 84577 - DNA, 402 bp, Homo sapiens
ttctgatcctacctaatgtagtcagccacctggggaatttactactccagcagggctaggtggggtctgaggatggtggtggaaaatcatatctccttctcactccctggtccaagtgtatgtatggaggtggaggactccctggctactccaatcttgtatcactactcttcaccctgtggggagtgtgtctggctgtgggtctctgtcttctgatacgtatagggatttttgataggaaaatgaagtgcagcatgtactctgatccccatcttgaggcaattctgagtgtttgttttgaatgtgacttgcctgatgtgattcaacaaacaattctgtgtttttgacatgccctcctttctgccaattatgtcttagaatttgccccttgtaaaaaaaaaa

SEQ ID NO: 84578 - DNA, 427 bp, Homo sapiens
cttgagaatcaacttttagatgacttgaatgataaatttttgataaattaaaaaatatttataattgtgtacatcgaaagtctcatgttttacaaaactcactccagaattctagagtgaagtcctgtctttcttaggaagcaatggaaaggtattaaatatctctcaagtgtttaattcattgtattctctactaggtatagattgttgtctctcagtttctaaattaaacagttgccttctcaagactttggtgatgatgattatgatgatggcaattacaatattaatatgactgagtgtttggatatcaaagatgagaagaggcctttcctttctaaaagaagtgattttttttgtgtgtggttgatttgtatttaatttcatttaggtaggtttggttctggatggatactagatttttgtg

SEQ ID NO: 84579 - DNA, 3430 bp, Homo sapiens
cgtgacgcgtgggctcgcgatttggtagtcaatatctgcagtggaaggcgctgtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctggtttgtatttcagcagtcagaaaaatttgcaaaggtggaaaaccaataccagttactgaaactagaaaccaatgaattccaacaacttcaaagtaaaatcagtttaatttcagaaaagcttgagtctactgaaagcatcctgcaggaagctacatcatccatgtctttgatgacccagtttgagcaggaagtatccaacctccaagatatcatgcatgacattcaaaataatgaagaggtgctcactcaaaggatgcaaagccttaatgagaaatttcagaatattacggatttctggaagagaagcctagaagaaatgaacattaatacagacattttcaaatcagaagcaaaacatatacattctcaagtaactgtccaaattaactcagctgagcaggaaataaaattgctcactgaacggctaaaagatttggaagatagcacactaagaaatattagaacagtaaaaagacaagaagaagaagatctcctgcgagtagaggagcagctaggctctgatacaaaggcaattgaaaagttagaagaggaacagcatgccctctttgccagagatgaagatctgactaataaactttccgactacgaacccaaagttgaagaatgcaagacacatttgccaacaattgaaagtgctattcactctgttctcagagtctctcaggatctgatagaaacagaaaagaaaatggaagacttgactatgcagatgtttaatatggaagatgatatgctgaaagcagtgtctgaaataatggagatgcagaaaacccttgaaggaattcagtatgataatagcatattaaagatgcaaaatgaactggatattctaaaagaaaaagttcatgattttatagcatactcaagtacaggagaaaagggaactttaaaagaatataatatagaaaataaaggaattggtggtgatttttaaattcatgacatttattctgatgaaccatatcattatacataaattgattagtccattgattttgagttactttgatacgcctcatcttatcctacattattggaaaataaatgagatgtccacacaaatggattatccacataatcaaagcttatctttttaagcactaaaacttacttcattgtaactatttgaaatagaaatagttctttaaaaatatttctctacttttaaaacaagatacttaatatttttaatgttttttaaagcattaatggacatcatcattaatttcacctattatattgtacccacatatattgatgtctccaggggctaataaagagtatttaccacttcactaaatgaccccaatttgccattttcaaacctatgtctcataccttttctgtcacctgaacttactgtcaggttggttggtaatgtgcctgcctcagccagttcactttcttaggtaattcactgcaggttaagaatccacacaaccaagttcatgggaattttgtgtaaaataaaagataacatgcctgagggagagcctggtgcctttgctatgaattaatatgcactttctgaaaactctaaagcctgggaaacattttagtttttgttaaggttctaaactgtgctacagatacttgtaagacttttaaaatcagagtaagtatgttcttacataaggcctttcttaggaattatgtgtatataaatctttgaaatatctttatatacctgagttttaggttccaactgtgttagacatgagtttgctagatccatggtctctagatggtttacttaaataggccaggcgcagtggctcacacctgtaatcctagcactttgggaggccgaggtgggcagatcacgaagtcaggagatcaagaccatctggctaacagggtgaaaccctgtctctactaaaaaatacaaaaaattagccaggcgtggtggtgggtgcctgtagtcccagctactcaggaggctgaggcaggagaatggtgtgaacccgggaggcagagcttgcagtgagccgagatcgcgccactgcactccagcctgagtggcaaagtgagactctgtctcaataaataaataaataaataaaaataagcctgtggcctgttttgagggaaaagtaacataactctgataattaattatgataataactatgatagttaaaaatacgtcattttaaagatttcccaaaccacaccactaaatttgttttatgaattgattttattttatttgaaattatataatgtagtcaactgcaatatggaagtttgttcttgtttctttgtcaataaccttaccagttttataatgcagtttttgatggaattaaacacaaagaacttgaaagcagtcagttacaaaaaggtagttgtggtcaagtagttttaatatgtaaatttgcaagtttttggagaacccccaaactccttctccactggagttaggagggcctgtggtagacagcgtgaatcatgaaaataagcctggagagttctgttattaaggggcatagcattaatttttgcagtcttaaaattacacttcttgacttctgaatgtctcttatttgcgtgcactgacaaaattctatttgtttacttttatattaatggtaataaaatagattataaagtaagctggaactttgttgttttaacctccatcctgtcaaggcaaatgtgatctcttatcttatatcctttacgtttaaatatttttttctcaccgatcaccacatttaatatgaggttattatgaacttatatataccatggtaatggttactgaaagtaaatggaaacaaggtggctactgttctctataatgacacaagggaaaggaagaaaactgcacttctacaagtataacatgagaaaactattaaagtatatatgcgtttgtatgtatgtatagatatctagatagatatatcctgtatttatgaagaggtttt

SEQ ID NO: 84580 - DNA, 1213 bp, Homo sapiens
tgatgtatggctatgtcgtccacgcgctcgggctgcactgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctgtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaaccta

SEQ ID NO: 84581 - DNA, 1331 bp, Homo sapiens
tgatgtatggctatgtcgtccacgcgctcgggctgcactgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctggtttgtatttcagcagtcagaaaaatttgcaaaggtggaaaaccaataccagttactgaaactagaaaccaatgaattccaacaacttcaaagtaaaatcagtttaatttcagaaaagtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaaccta

SEQ ID NO: 84582 - DNA, 1485 bp, Homo sapiens
cgtgacgcgtgggctcgcgatttggtagtcaatatctgcagtggaaggcgctgtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctgtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaacctatttttgcaactttacatagcaagaactttatccatccttctgacatacatgttgttacccacacacacacac

SEQ ID NO: 84583 - DNA, 1154 bp, Homo sapiens
cgtgacgcgtgggctcgcgatttggtagtcaatatctgcagtggaaggcgctgtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctgtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaaccgtcgattcgaggtgatcctctg

SEQ ID NO: 84584 - DNA, 504 bp, Homo sapiens
gctaccgactagagtgctcacaaaaaaaccccaatttaccagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaaccta

SEQ ID NO: 84585 - DNA, 660 bp, Homo sapiens
gtaagtggacgcgaggctgcctgggccggcctcctgtgggccccctgctgtttgggctcccacccggctcaacatccagccggaggtgatccaacctcccagacctgggccttctgtgcctctgtcttgaccccaaaggaaggaaacagcccagccttgtttttccctttcgggcgtttcttgtatctcatttccccccgtgctggtagcatgcccctatcgctcagaaggagttgaggctaaggtttgggaacgagccatttgttaagagctgcagattcggccacgctttctgaagctcccgctacacgtcagaagcgttcacgttgttataaaccgttacttcctgtccgctgtgccccattccgggacacatctgccccaccctactcaccccataaatacctaatggaaatacttgcaaccttaaaacagatcattatgtttggagaccgaggcaggtggatcacttgaggtcaggagttcgagactagcctggccaacatggtgaaaccccatctctaccaaaaatacgaataatcagccgggcgtggtggcgggcgcctgtagtcccagttcctccggaggctgaggcaggagaatcgcttgaacccgggaggcggaggttgctatgagccaagatcgcatcactgcactcca

SEQ ID NO: 84586 - DNA, 1413 bp, Homo sapiens
cgtgacgcgtgggctcgcgatttggtagtcaatatctgcagtggaaggcgctgtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctgtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaaccta

SEQ ID NO: 84587 - DNA, 1296 bp, Homo sapiens
ggcaggcggtacgcccggggtaacgggattgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctggtttgtatttcagcagtcagaaaaatttgcaaaggtggaaaaccaataccagttactgaaactagaaaccaatgaattccaacaacttcaaagtaaaatcagtttaatttcagaaaagtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaaccta

SEQ ID NO: 84588 - DNA, 1001 bp, Homo sapiens
tgatgtatggctatgtcgtccacgcgctcgggctgcactgtcctgctccccctggtgaagaagctggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaaccta

SEQ ID NO: 84589 - DNA, 1398 bp, Homo sapiens
  misc_feature (1397)..(1397): n is a, c, g, or t
cgtgacgcgtgggctcgcgatttggtagtcaatatctgcagtggaaggcgctgtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctgtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaatatacaagtaggaaaccgtcgattcgana

SEQ ID NO: 84590 - DNA, 866 bp, Homo sapiens
cgctcgcgcctctccctccacacctctctgcaagctgagggagccggcttcggccttggccggcccagaaaggggctcccacagtgcagcggcgggctgaagggctcctcaagtgccgccaaagtgggagcccaggcagaggaggcgccgagagcgagcgagggctgtgagggctgccctcatgctgtcacctctcacctgggtctggagctgcagctgtgcccagaagtgtgggctcccgctggccttgtggagcgcacaactctggccacaccccccacttcagccagtttcttctcagcagccactccagagggaccacctctggcatcttaaatacattaccagctctgctccaagattttttctccctgggatcaggctggagtgcagtggcatgatcatagctcactgtaacccccaactcctgggctcaagcaattccctcctcagcctcctgagtggctagaacttcagggatgtgtcaccacacccaggtctaagtcatcagaaaagaacattagaacattctcacagagccttacaatctgaaaacccactgcctttcgaaaggatcaggcaagtggttggactaaattacattcccgctgacagtacgaatttggaatagagatgtacaaagacacgagggaaatgcttggaagctctcaagtgcggagaattctttgcacagactccctctctctgcacagatgaacaccatgagcttgctggaaggggttcaaagaacagcccacagcagcactcgagtttgctaaagtgactgacgttggcttcagtttggaatccaaaggcgacaactgacaaggaagagcggaagggaagggagaagtgagatttgaaca

SEQ ID NO: 84591 - DNA, 724 bp, Homo sapiens
  misc_feature (33)..(33): n is a, c, g, or t
gacgtaacttccggtgtacacagccggtccaangcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtca

SEQ ID NO: 84592 - DNA, 302 bp, Homo sapiens
cctgttggttcacaagtctcttccctactctgcatccagtgatatcacctcgggagcttgaaatctctgtaatgggagtacttaccttatggaaatcagcaaactttagaaattggggattcttccttctatcagagagatgagtgttacacttatcagcacaccattgaaaaccagaaacctctgaaagtgagaggaagagcagtgggaaagggatcaggtttggtaatgcttaagacggagctctgaaggatacaatttgaggcctggagaaggcatcatatgtatcatacatcaatttc

SEQ ID NO: 84593 - DNA, 497 bp, Homo sapiens
acagaggttgcagtgagtcgagattgtgccactgcactccagcctgggtgatacagcgagactccatctccaaaaagaaaaacaaaattctaggaagatattgaacagtggtaatctctgaaaagtgggaatgtaatttttttattttgctttactgtattctctagttttctataacgcagttaatgaattgctgggatgatgcctccagtgaatgaaagggggtgctatctagggtgtgagttcactttaaagcagggagcaaggacaacacatccacaacattggagggaaagcaggaaaagagagcttggaggtcttggactggtttcctgggtctccaacagccgagcactatgtctaggaggaggaaagcaatcaccccaaattccacaagtccaaacaggctgaagaagcgggtgttttgcaccagttgcatgtaagtttctgaagctggagcttagggctgcctgatttttgagggaattgcaaactct

SEQ ID NO: 84594 - DNA, 412 bp, Homo sapiens
tctgatccacctctgttgacaccctgagtggagggcctgagaggaaagagcctgctgatcaggcccctcgacttgagtgaagggcaggcagggagggtcctatggctcctgggaggagccgaagggtggatcgcctgtcaaagccaagagccctgatggcgggcgccagggaaaaggccctgaggcggggtcacagccctggaggggcagcgtccacactcctgcacagtgcagggcacctgggactctcaaaacccgccggctgctgcaccttctgggaccgggagagtgtcagctgggtgaatcccgcacacgggcgcgggggcgcggcgcgtagttgtggaaccggataccccgcgggctgctggctccagcgcctccacctgccactgggccaaccccctgggcctcc

SEQ ID NO: 84595 - DNA, 204 bp, Homo sapiens
ccaggaagtggaggttgaagtgagccgtgattgtgccactgcactctagcctgggcaacagagagagactctgtctccaaaaaaaaaaaaaagtttcatattttactctacattcagataaataacatttgccatttgtaaggcttttcattttgaatatttagttgtatttattatatactaggcatcattcttgttgctgtt

SEQ ID NO: 84596 - DNA, 463 bp, Homo sapiens
ttgattcatattcattacaactctagaaaaaaggctggcaaaaaaactaccccaggggcaaatctggcttacttgtctttggaaagaaaaattgtactggaacacagccatgcctatttgtttacatattgcctatgggagttttcacacttaccatggcagagataagtagtttctacagagaccacatggcccacaaagcctaacatatttattgtctctttacagaaaatgtttgcaacccctgttctacaggaattttatctctagaatctagagatatgatatgcaaatttaaaatatatagatatagcaacacctttaaaaacataagtggaggccgggcacggtggacgcacctgtagtcctagctacccgggaggctgaggcaggagaatcgcttgaaccggaaggcagaggttgcagtgagccaagatcgcgccactgcactccagcctggtga

SEQ ID NO: 84597 - DNA, 460 bp, Homo sapiens
ccaacagtggagagagatgctctcatctttgaactctagggcctaatggttgcccaggtcagctatatctcccttgttttcttagtgaagtagttattctctcttctatcctttgaagcaattcccttctgcctgcaaagtttggtttgaaccttaaaggttttcaaaagcactaagaaatacttctgttttagtaacgttatattttccttcagtatttctagtttacatgtaatatctgtcaagtggcacattttttaggttctctctgttgtaccaatagacaacttgaaggagcttttatgtgcgtaccacttaatttgtgtatgaggaggacagaaccttaaccttgctgaaaagaggagtcgataagaaaatcacaagaagtgtttaacctgtgatgacaattttaacttgccattttttcatttttcacaaggtcagatataaagtgtgcagt

SEQ ID NO: 84598 - DNA, 426 bp, Homo sapiens
tactacctccattactttccatttttcaggttacaaaataagaaaacaatggatttgagtataattttttgtcacacagtgaagttgtctcgctgggtgagatattagatactgtgttcacatgtaatacattaaagttcaaaaaaattttaaagttatgtttcattcattcattcatttagaatagagatgggtctcactatgttgcccaggctggtctcaagctccagccttcaagtgatcctcccatctaggcctcccaacatgctgggattataaatgtgagccacgaagcccagctgaagttattaaaaaaattttaacagcacaagtagccagggatactggatggaaactttctactttaaatctctaatttaacattttcatctcaaaatttaaaacctctcccacactttttggctt

SEQ ID NO: 84599 - DNA, 403 bp, Homo sapiens
ctgctgtattttaaaatgccctctcaaactaaaggaaagaatgggtcatgcactgccactgtctcacgaccccttttcaaagaaacaaaaaaggaaacaaaaaaacaatagaacaagatcctaccagaatgacctccacatagtgatcattcttaagtacagagtatagatatgcagctcacataaaactgctgcattccagcaatcaatgcagtcccaaagtaatccacagatttaggcagttcaatctgcgacccttttcactaggaagaaatgctaaatcattacaagcgccaccatcttagagcagcagcaactgcaatagcttgcactcataattctcttatggttaactgctcacccattgcctctgaggaaatcttgtattgtaatctgaacttaa

SEQ ID NO: 84600 - DNA, 242 bp, Homo sapiens
tcaaggtcacacagcaatttagtgaaagggccacacacagaactaagggcaccgagggctagggtgtccactatatcacactgcctgtcattttgttggtggactaccttgccccttatttatttatttattattagtattatttttttgagacggaatcttgctctgtcgccctggctggagtgcagtggcgtgatctcggctcactgcaacatctgcctcctgggttcaagcgatttctg

SEQ ID NO: 84601 - DNA, 322 bp, Homo sapiens
aagtaaagacttaaacatgtttaaaagataattggaagactccagttaagaggatgaaattaaatattcaagagatacttgaggatcaagtaagcttcctgagaaactgggaggaataggatccaaagcatagcatgagggactattagccttagatagaggaacagtcatttttctctaacagcagcagacgggcctaggttatgtaaggaagctaagggagtactttctgatgcctgctgttttctctgaaatagaaaaccaagtcattttctaagagtgatgagtgaggactagagcaggcagtttgaggagactgagg

SEQ ID NO: 84602 - DNA, 424 bp, Homo sapiens
aaactatggaacagcattttgaatgacaatgaatttctttcaaaaactatggaggccagaagaagtggcacagtatttttcaaacagtgaaagagaagaattgtcaatagcaaattttatatccaacaaaactacactttaaaatgaaggtaagatattttatttcatacatcattagggatatacaaattaaaacaaaaatgtgatattactgtacacctatcaagattggccaaatttcagaatacttatgacaccaaatgctggtgagaatgtgaaacaacaggaactctcattgccgttggaaagcaaaatgttacagctactttgaaacagaactcctataagatagattgggtccacagtgtatgactgattatgatgtgagtggtgggtatcctgtgaaatttggcaatgtgatgat

SEQ ID NO: 84603 - DNA, 586 bp, Homo sapiens
atcaccctctacgaggaccggggcttccagggccgccactacgaatgcagcagcgaccaccccaacctgcagccctacttgagccgctgcaactcggtgcgcgtggacagcggctgctgggtgctctatgagcagcccaactactcgggcctccagtagttcctgcgccgcggcgactatgccgaccaccagcagtggatgggcctcagcgactcggtccgctcctgccgcctcatcccccacgccagctcccacaggctcaggatctatgagcgagaggactacaggggccagatggtggagatcactgaggactgctcctctcttcacgaccgcttccacctcagtgagatccactccttcaacgtgctggagggctcctgggtcctctacgagctgcccaactaccaggggcggcagtacctgctgaggccgggggactgcaggtggtgccaggactggggggccacggatgcgagagtgggctccctaaggagagctgtggagctctactgaaatgtttgtactctatcccttgcttcatctggaaactaataaaatatttcctgtgtgttctatgcaaaaa

SEQ ID NO: 84604 - DNA, 232 bp, Homo sapiens
caaactttttccagagctacgtggactctagccccagccctgcccctaaccagcagtgtgaccttgggcaaagcagttaccgtctctggtatttggtcaggtgaccagatcttgaaagtccccttggtggtaacattctgtaagttgatgactccgctcctggggaaatttccagggtaagcaatgacagttgactagcacatttgccctgctgtgttccactttaccagtt

SEQ ID NO: 84605 - DNA, 1158 bp, Homo sapiens
cgagaggtggggtggggggattacaaacctctaacagcaccacaggctgcccggggaacatctgctactacagccttgcagcccggagtcccggattttactggttcccgtgcctgcggacaggcccccagggctagcggctttgtggagggaacactgggtatcctctccacagtccaggtgctgggaggccctccttggcttaggaggacacttccaaagctggggcgccccaaggaggcaccagtggccagaatgtccacgcagagcacccaccccctgaaacctgaggccccacgtctgccacctgggatccccgagtcccactgcagctagtcgagtctggacgcacaacagcgaactcgccgtgtcgctagctgtatgtctgcgcgtagcgcgtcattccacgagagggacgactgtcgaggctgactctgttggagaatcagagggcgtgaaagtccattcattcgtccagtcgtgtgggccgtctgcgcccactgtagccttggatgatagaatcctggctagctttctcgtgatcgcctagtgtcacacgatgcatgtcccgtgtggcatgcgttcggacggagggagctctagccgtatagtgagtcgttcactcattcgcgtctccgcctcatgggtacaaaggcaagagacgtcactggcagtgaagtcatctgacctgctggcatcacggtccatggggggctcatcatagcgccacactgcaatttgtctgtgtcgcgtgtcactcgcgccttccggcagcagggcaggggccccatcctgctgtggcgctacctgcaccacctgggcagccagccggccgtgcgccgggccgcgctcatgtgcgaggacgcgctggtacccttctatgagaggttcagcttccacgccgtgggcccctgcgccatcaccgtgggctccctcaccttcatggagctccactgctccctgcggggccaccccttcctgcgcaggaacagcggctgctgaactgggctgcccacctggctgccaacatgatccccgtctctgccctgggctcctcttagctcagctgagcatggagacagcagtttccagagagtggagagagcagggctaaataaagaggagataaggtggcttctcacggcctgaaaaaaaaaa

SEQ ID NO: 84606 - DNA, 1035 bp, Homo sapiens
cgagaggtggggtggggggattacaaacctctaacagcaccacaggctgcccggggaacatctgctactacagccttgcagcccggagtcccggattttactggttcccgtgcctgcggacaggcccccagggctagcggctttgtggagggaacactgggtatcctctccacagtccaggtgctgggaggccctccttggcttaggaggacacttccaaagctggggcgccccaaggaggcaccagtggccagaatgtccacgcagagcacccaccccctgaaacctgaggccccacgtctgccacctgggatccccgagtccccgagctgtcagcggcgccacacactccctgccagtgagtttcgctgcctcaccccggaggacgctgtcagcgcctttgagatcgagcgtgaagccttcatctccgtcttgggcgtctgccccctgtacctggatgagatccggcacttcctgaccctatgtccagagctgtccctgggctggttcgaggagggctgccttgtggccttcatcatcggctcgctctgggacaaggagagactcatgcaggagtcactgacgctgcacaggtctgggggccacatagcccacctgcatgtgctggccgtgcaccgcgccttccggcagcagggcaggggccccatcctgctgtggcgctacctgcaccacctgggcagccagccggccgtgcgccgggccgcgctcatgtgcgaggacgcgctggtacccttctatgagaggttcagcttccacgccgtgggcccctgcgccatcaccgtgggctccctcaccttcatggagctccactgctccctgcggggccaccccttcctgcgcaggaacagcggctgctgaactgggctgcccacctggctgccaacatgatccccgtctctgccctgggctcctcttagctcagctgagcatggagacagcagtttccagagagtggagagagcagggctaaataaagaggagataaggtggcttctcacggcctgaaaaaaaaaa

SEQ ID NO: 84607 - DNA, 323 bp, Homo sapiens
tgtcccagattatctaaggtggaatgcctttgcgaaaagcattagtttgtaatcatatcgtataacaaagaaactgtgctgactagttctagttagctttaagataaggataaattaggttttcaatttaatggtaaaacacactctgctttcttaactctgttactacctatttagtgtttgttttcctcttactgtgaaagtaacatgctgattatagggaatatataaaaaaagataaaaagcactcaattctattgactaatgataacctcaacacttcggtgtataccatatattttttaaataggcagattacattg

SEQ ID NO: 84608 - DNA, 429 bp, Homo sapiens
agtagctgggacttctggcgtgtgccaccatgcccggctaatttttgtatttttagtagagatggggtttcaccatattggccaggctggtctcgaactcctgacctcatgatctgcccacctcggccttccaaagtgctaggattataggggtgagccactgtgcccagtgctgctccttttttcttgcaacatgcggattaccatacctttcctcttttcacctttagcccactttttccctttaaatactgaagccctcagcatcatctctggagaaaaggcacagaccagactgtttctgggattccctatttagttcttccaggcatgtccttaaccttggcaaaattaacttctaaattgttttagacctgtgtcagataatttttggtgtacagtatgtggtcactttcccccaagatttaa

SEQ ID NO: 84609 - DNA, 452 bp, Homo sapiens
tgcaggatctgtgtctttagatctagctgtctgaacttggacctcagttgccacattcgtgaaatggggaaaatatctataagctcataggattgctgtggtgatcaaagaacttgaggaattcaggaaaaacttcacaggaaaatgtggactggaggcaggccttgcaggtaccagggaaggggaagcaggaatggcctggagtagtgaggacccagcacaagccagcctcaatgctttgaagatcaattaggagagacttaaaagatgagaggataggcaggaaacatgaaggtttataagcacaggagaaaactgtgaacagactaatcttcttaaagggtcaaagaaaagtaaatttttttttttttgccttttcagcatgtgccaatgtctacatcaaggccattcatatgagtgactcaaaggcaacctgcttgtcaagtaattgg

SEQ ID NO: 84610 - DNA, 464 bp, Homo sapiens
gtcagggtttttgcttgcttgtttttgtgtgtgtggttgtttttgcatgctctagttcatttagagcactaaattaaatgtgttcattcactttttcattccataaatattttaccgcttacaaagtgacagatgttgtgctaaagctggagatagaatggaaagcaaaggatagacacgggctctgccacaaggcttagttcagtaaactaagcatcacacaatgaatgttaaattgtaacggtgaagtgccaggacaaaaagatagagagcagtcagagtgtgtaataggaggactaaaccttgacaaggaatcagggaagttttcctaaggaaggattattgtactgacatttgaaggaaaagtagtggttgggcattgaggacaggggtggaaagtgtgggaacagtattgcaaactgagcagcatttgaaaagcactggacatggcacatttgaggaac

SEQ ID NO: 84611 - DNA, 100 bp, Homo sapiens
atgacatagagaacgataacattgctttgggagattaaaaattcaaatttaaaaaaaatgtgacagtggtcagcaagattgctaatattgagatgaaata

SEQ ID NO: 84612 - DNA, 752 bp, Homo sapiens
ctccggaagcaccgatttccagcgctgacggccgcgcctggtttcccagcgagtcctcttggcagctcccgcagctccccgccgggagcacgagtgggagcgaacccagagcccgcccaggcctcgggcctcggcaactcctcacaggtccacgagatggcgctgcaggccagggcccgggccgcggcctcacagcccgcctcgggcgagagcgggagatagactgcggaccccggcaagcggggcacggaggcacagccaccgacacaggcagagccgggtccggagcccggcacaggccgccgagggaccgagggactccggggctgcggacacactgagcggagggcttgaggctcggggtggggccttctcccctgctgccagaaccgcccggcagcgccagctcggcgaccttccaggctgctgcagaccccagcttgtcctcttctgcgcgcccgcggggctgggccctcgcgttctctctgcgggaagtgagccgccggcctccggcctcctgggcccctccgaagggggctgtggctggcatccgcagcgcgcggggcgcacggccctaggagcgcggggcccactcgacggtgaggacttacgggcgggataggggaaggatcggcggggatccagcgctcctccagcggagagggccccctcggctccgacccgccctcctcaccaccctcatccggctcttcagggcggggtcttcagggtcgagggcaggatgtgccctg

SEQ ID NO: 84613 - DNA, 784 bp, Homo sapiens
gggaaaataagcacagggagactgtcagagaaagccactgatcactgaagctggaaaacataattcaccgtcagaagatgatttttaaatacaaagaacaattatataaatagtttggtgggatgaatatgggataaacttaagaataaaaatcagtgcatctacaatgccaaatattatgtaacataagtctacaacatctttctgtcccaaccttgaattaaaactctgaagaaaatggtttcattcatgaaaccatgattttagcttctgttaatgaatgacttgcctttaagccaaaaattatttatcgaatccgacactcatgtgagaaatcctaactttatggattcacctcctttctcaatccttccccaagaagctcacatctattacagattggtatagatctgagtaaaatgcaatgtaagggaagatctgggttcagagggtagataaatgtatgagtttgtcttatctattttggaatgcaagctcagtgtccatttaacataaagcatcagctgaaaaagttaaacatcaaccactttgtaaatatttgtaatgaattacttcaataactgcacattttaaaactcacagaggattaaagtagtaggataaagtattccaataactaactgtcctcctaactcttctatgaagtaaacaatctttgtttatatttgagactacatttaaaagcaaatatagatttgttttaatcgtgctatgtattggtttatctttctcactgttcccatttgttaatgcagaaaatact

SEQ ID NO: 84614 - DNA, 6207 bp, Homo sapiens
  misc_feature (5018)..(5018): n is a, c, g, or t
  misc_feature (5160)..(5160): n is a, c, g, or t
  misc_feature (5162)..(5162): n is a, c, g, or t
  misc_feature (5227)..(5227): n is a, c, g, or t
  misc_feature (5270)..(5270): n is a, c, g, or t
  misc_feature (5373)..(5373): n is a, c, g, or t
gaattctaggcccagttctgtgtttcccctgtgtgttcctaggcaggtcagtttccctccatgggcctctgtaagatgaggagttggagaggtacattctcaggctactttcaactcccagccaagtgactcaagagtcccaggcagcaccagcacccctatctccaaggcctcctgatgtgtgtctctatttagaacttaatccaacctacccaacatcagatcagtgtcttaccagcccaaggtccctggggagcctcctagagggagagagccctgcccacccagattgagggtaaaggcctccccgtgctcatttttgtaccaccacagtgcttggcacatggtagacatcaaaatgtgtgtgctgaaagtataattgaagttgtgtatatatgtcagctagagtgtctggaggggcagaaatgtgggtctaaaacatacaaatgctccaaatggggtgtgggcaagggtctgtctacaccaggctgtgattacctgctcacatacatgtgtctatctgagtaggggtatgttatctatttttctacaccacagggtgaggaacaggtatatgtgtgcatgtgtatgcatccgtgtgtgtgtgtatgtgtgtgtgcatgagtgtgtgtgtgtgtgtccaaagccacctcttcaacctgtgccatttgtatctgtgtctggcccaatgagagtgttgaaaggtgagccacaagataaaacagcaacttcctacctcccttatcaagacagctgtctgacctacctccccttggccactcttgggattactggggttggcttcagtattttcagatttttcagaaggggaggagaatgcttgagtctcatccaggaacttaggcagttctcagcactgcctgctcctcctccctcaaataaccaagtctgaagaccaggagagaaagccgctggtggactggtcacctgtctggcagtgggaggaggagagtgagaggtttctaggtaggaatccagacttagaccctcccctccacccccagatgggtggtgcacaggctcatctcgcggcccctccccactccaccctaacatggatacgcccccaacaaccaaggaaagatctcccatcggctgactccacagatacacacatgtccccacagacacacacacgcccatgcagaggcacagacatccaggcacatctttccctttctctgtctttcccttggtttgaatttcgtttagccacatatgttgtgtgtgcgtgagggtgggtgggggaggggcagacagggatgagggatggcatggtgccaacatctacctatggggctcgggccagggacgccccttacagccatcctgggagggggtctcagctgtccctttgtggccaaggggaccctcctggggagtgggggcaagcacagaggtcctttctccccaacccggggtctggtccctgacccaccttgggggcctgcaggggaggaaatggacagagcgggaccctgagggagcatagaattggccaccacgagcccccagtgtccagccttgccaccccattgttcccgtgagggggtctctatatacagggggcaactcctcccaccttcctctcaatccctgctttccctgcgttgggcggggaggggagggcggcagaaatatttatttatttcctttatttatttaatttttttttttttttttggagtagagagtgacagatggcggcgggtcccgggggagccggctctcccccagtgcagacgcatgccaatcaccgtctctcatgtgatagctgctgcccgtgacgtgccaagcccatatggcctggcatagaggctggtaccccgcctggtagagatgccacactcgctccgcggttcgcatggcgctctgaagacgccggcgcccgccgccttgaggagccgctgcccccgctccctgaagatgggggaacaatgaaataagcgagaagatccctcttctcccccctctctctcttgccccctccccccctcccctcccctctccccttgactcctctccgaggtaagttgtccgaaagggagcgagatctgacccgccggttgggaggaggggcggcagcttcggccgacaggagggtcctcaaatacctccttcctgggatgatgcccccctcattgggtgggcatcggaggggccccaggttctctctcccttaggggctgcagcccagggggctgcagaggaggtgtctctgcctgcgatgggctcggtggggggggaaggcaggatcacggagggggatatgcgaagaggccgagacggaggacccctccatggttgtcccaaaaagcctgccacctttccccaccaccgaaaaaagggaagcaaacaaacaaatttggatttttcccccatcaatcccaaaatacaacgagatctgaagagccttgtgggagggagtcagcttgaagggggaagggggtccctgaccgcagaggggacggactgggctcgcttctctcagtctcctccccacgccccgctgcttcagtcctcgccgcccagagccggctccgggagctggggacgcatcggctagaggagacgatcctcccgcctctggaattgggggtgcgggggtgggggccgagcaaggggcggcgcgcagccaagttgcaaattggattagggagcgtgggggtgagagccacgggaggggtgagggagctgggccggggggcccgggccgcgagagcgcggagcggggcagctgtccccaccggcggccgaccagcctctctccaccgccaggagagaacgggctttcagggcgagcgcgccgcctcccctggcaaagatatctggtccctaaaacccccacccggtccctgccctgaccctgagaagaagcaggcgcggggagcagccccccattcaagcgaggggcggagccggggcccagcgccggggagagggcctgggccgagatcccaggccggcagccgggtagggctgggccggctctgggcggggcaggcggcggaggtgggcatccagggtagcctaggcaggagcccgcacgagactcgggggtggaggagggttgtgggggggcgtcggtaccccagcgcgcccctcactttgtgctgtctgtctccccttcccgcccgcggggcgccctcaggcaccatgctgacccgcctgttcagcgagcccggccttctctcggacgtgcccaagttcgccagctggggcgacggcgaagacgacgagccgaggagcgacaagggcgacgcgccgccaccgccaccgcctgcgcccgggccaggggctccggggccagcccgggcggccaagccagtccctctccgtggagaagaggggacggaggccacgttggccgaggtcaaggaggaaggcgagctggggggagaggaggaggaggaagaggaggaggaagaaggactggacgaggcggagggcgagcggcccaagaagcgcgggcccaagaagcgcaagatgaccaaggcgcgcttggagcgctccaagcttcggcggcagaaggcgaacgcgcgggagcgcaaccgcatgcacgacctgaacgcagccctggacaacctgcgcaaggtggtgccctgctactccaagacgcagaagctgtccaagatcgagacgctgcgcctagccaagaactatatctgggcgctctcggagatcctgcgctccggcaagcggccagacctagtgtcctacgtgcagactctgtgcaagggtctgtcgcagcccaccaccaatctggtggccggctgtctgcagctcaactctcgcaacttcctcacggagcaaggcgccgacggtgccggccgcttccacggctcgggcggcccgttcgccatgcacccctacccgtacccgtgctcgcgcctggcgggcgcacagtgccaggcggccggcggcctgggcggcggcgcggcgcacgccctgcggacccacggctactgcgccgcctacgagacgctgtatgcggcggcaggcggtggcggcgcgagcccggactacaacagctccgagtacgagggcccgctcagccccccgctctgtctcaatggcaacttctcactcaagcaggactcctcgcccgaccacgagaaaagctaccactactctatgcactactcggcgctgcccggttcgcggcccacgggccacgggctagtcttcggctcgtcggctgtgcgcgggggcgtccactcggagaatctcttgtcttacgatatgcaccttcaccacgaccggggccccatgtacgaggagctcaatgcgttttttcataactgagacttcgcgccggctcccttctttttcttttgcctttgcccgcccccctgtccccagcccccagagcgcagggacacccccatcctaccccggcgccgggcgcggggagcgggccaccggtcctgccgctctcctggggcagcgcagtcctgttacctgtgggtggcctgtcccaggggcctcgcttcccccaggggactcgccttctctctccccaaggggttccctcctcctctctcccaaggagtgcttctccagggacctctctccgggggctccctggaggcacccctcccccattcccaatatcttcgctgaggtttcctcctccccctcctccctgcaggcccaaggcgttggtaagggggcagctgagcaatggaacgcgtttccccctctcattattattttaaaaacagacacccagctgccgaggcaaaaaggagccaggcgctccctctttcttgaagagggtagaagttagggcgccggagcccgggcctggaacgccctcacccgcaacctccagtctccgcgttttgcgattttaattttggcgggaggggaagtggattgagaggaaagagagaggccaagacaatttgtaactagaatccgtttttcccttttcctttttttaaacaaacaaacatacaaaaaaaaaaaaaaaaaaaaaaaaaaaaaaagctaanaggcgacggaagccgaacgcagagtccggatcggagagaaaacgcagtaaggacttttagaagcaataaaaggcaaaaaaaacaaaaaacaaaaaaacaaacaaaaaaaaaccactactaccaataatcaaagacacaaatntntatgcaaggaggctccactgagcctcgcggcccggcccggccccgggatgccccgcccggcctgngggccgccccgcccgagcgcggatctgtgcactttggtgaagngggggcccgcgccgccccctccccctccccaggttcttacaatcagtgactcggagatttggggccccagtgccactgccctcccccgccccgtccccgttgngcgtcatgctgttttttaaaaacctgtttccaaatttgtatggaatggcaaactgttggggggtcggtttggggagggagggtttgcatgaaagacacacgcacaccacaccgcacgcacaagcaggcccggcgccggcgtccggggggcagaaggaggtgagctcgccggctcctcctccccgcggccattctgtcccctcctggggtgaggggtggggatggagacctgggggcagccccacccctgcccggactgtgcctcggtgggtgccacctggcgatttccggtgtctggagagagtattttttggtccaaggagtcctcttggctttagctggtgggtgggcggggagaggtctgagggctcctactggaggttcccccaaaaaggggcaaaaggagaccctctgcccaccggaggcaggggatcaggcatccaaatacacgatgcaaaaatgcaatcccacaggcgacacacccacacactcacccacacacacgcaattttaccttcctcttgtagcgaagatgaaactcccgtcggacacccgaagtgcattgcgtgtttctgttcagtttaatgacgattaataaatatttatgtaaatgagatgcaaagccggaccggtttctcacggtggcctcatttcattgaggggggagagaaggtttgagctggggctggggtgatgaaggcagagtgtcaagtgactgtgcagaggccaaacagagggaccctggacattcttgggtagtattctctccctaaccaccccccatacacccactgggctatactagctacccctcccagacccaacccaggctcgc

SEQ ID NO: 84615 - DNA, 5084 bp, Homo sapiens
  misc_feature (3895)..(3895): n is a, c, g, or t
  misc_feature (4037)..(4037): n is a, c, g, or t
  misc_feature (4039)..(4039): n is a, c, g, or t
  misc_feature (4104)..(4104): n is a, c, g, or t
  misc_feature (4147)..(4147): n is a, c, g, or t
  misc_feature (4250)..(4250): n is a, c, g, or t
gaattctaggcccagttctgtgtttcccctgtgtgttcctaggcaggtcagtttccctccatgggcctctgtaagatgaggagttggagaggtacattctcaggctactttcaactcccagccaagtgactcaagagtcccaggcagcaccagcacccctatctccaaggcctcctgatgtgtgtctctatttagaacttaatccaacctacccaacatcagatcagtgtcttaccagcccaaggtccctggggagcctcctagagggagagagccctgcccacccagattgagggtaaaggcctccccgtgctcatttttgtaccaccacagtgcttggcacatggtagacatcaaaatgtgtgtgctgaaagtataattgaagttgtgtatatatgtcagctagagtgtctggaggggcagaaatgtgggtctaaaacatacaaatgctccaaatggggtgtgggcaagggtctgtctacaccaggctgtgattacctgctcacatacatgtgtctatctgagtaggggtatgttatctatttttctacaccacagggtgaggaacaggtatatgtgtgcatgtgtatgcatccgtgtgtgtgtgtatgtgtgtgtgcatgagtgtgtgtgtgtgtgtccaaagccacctcttcaacctgtgccatttgtatctgtgtctggcccaatgagagtgttgaaaggtgagccacaagataaaacagcaacttcctacctcccttatcaagacagctgtctgacctacctccccttggccactcttgggattactggggttggcttcagtattttcagatttttcagaaggggaggagaatgcttgagtctcatccaggaacttaggcagttctcagcactgcctgctcctcctccctcaaataaccaagtctgaagaccaggagagaaagccgctggtggactggtcacctgtctggcagtgggaggaggagagtgagaggtttctaggtaggaatccagacttagaccctcccctccacccccagatgggtggtgcacaggctcatctcgcggcccctccccactccaccctaacatggatacgcccccaacaaccaaggaaagatctcccatcggctgactccacagatacacacatgtccccacagacacacacacgcccatgcagaggcacagacatccaggcacatctttccctttctctgtctttcccttggtttgaatttcgtttagccacatatgttgtgtgtgcgtgagggtgggtgggggaggggcagacagggatgagggatggcatggtgccaacatctacctatggggctcgggccagggacgccccttacagccatcctgggagggggtctcagctgtccctttgtggccaaggggaccctcctggggagtgggggcaagcacagaggtcctttctccccaacccggggtctggtccctgacccaccttgggggcctgcaggggaggaaatggacagagcgggaccctgagggagcatagaattggccaccacgagcccccagtgtccagccttgccaccccattgttcccgtgagggggtctctatatacagggggcaactcctcccaccttcctctcaatccctgctttccctgcgttgggcggggaggggagggcggcagaaatatttatttatttcctttatttatttaatttttttttttttttttggagtagagagtgacagatggcggcgggtcccgggggagccggctctcccccagtgcagacgcatgccaatcaccgtctctcatgtgatagctgctgcccgtgacgtgccaagcccatatggcctggcatagaggctggtaccccgcctggtagagatgccacactcgctccgcggttcgcatggcgctctgaagacgccggcgcccgccgccttgaggagccgctgcccccgctccctgaagatgggggaacaatgaaataagcgagaagatccctcttctcccccctctctctcttgccccctccccccctcccctcccctctccccttgactcctctccgaggcaccatgctgacccgcctgttcagcgagcccggccttctctcggacgtgcccaagttcgccagctggggcgacggcgaagacgacgagccgaggagcgacaagggcgacgcgccgccaccgccaccgcctgcgcccgggccaggggctccggggccagcccgggcggccaagccagtccctctccgtggagaagaggggacggaggccacgttggccgaggtcaaggaggaaggcgagctggggggagaggaggaggaggaagaggaggaggaagaaggactggacgaggcggagggcgagcggcccaagaagcgcgggcccaagaagcgcaagatgaccaaggcgcgcttggagcgctccaagcttcggcggcagaaggcgaacgcgcgggagcgcaaccgcatgcacgacctgaacgcagccctggacaacctgcgcaaggtggtgccctgctactccaagacgcagaagctgtccaagatcgagacgctgcgcctagccaagaactatatctgggcgctctcggagatcctgcgctccggcaagcggccagacctagtgtcctacgtgcagactctgtgcaagggtctgtcgcagcccaccaccaatctggtggccggctgtctgcagctcaactctcgcaacttcctcacggagcaaggcgccgacggtgccggccgcttccacggctcgggcggcccgttcgccatgcacccctacccgtacccgtgctcgcgcctggcgggcgcacagtgccaggcggccggcggcctgggcggcggcgcggcgcacgccctgcggacccacggctactgcgccgcctacgagacgctgtatgcggcggcaggcggtggcggcgcgagcccggactacaacagctccgagtacgagggcccgctcagccccccgctctgtctcaatggcaacttctcactcaagcaggactcctcgcccgaccacgagaaaagctaccactactctatgcactactcggcgctgcccggttcgcggcccacgggccacgggctagtcttcggctcgtcggctgtgcgcgggggcgtccactcggagaatctcttgtcttacgatatgcaccttcaccacgaccggggccccatgtacgaggagctcaatgcgttttttcataactgagacttcgcgccggctcccttctttttcttttgcctttgcccgcccccctgtccccagcccccagagcgcagggacacccccatcctaccccggcgccgggcgcggggagcgggccaccggtcctgccgctctcctggggcagcgcagtcctgttacctgtgggtggcctgtcccaggggcctcgcttcccccaggggactcgccttctctctccccaaggggttccctcctcctctctcccaaggagtgcttctccagggacctctctccgggggctccctggaggcacccctcccccattcccaatatcttcgctgaggtttcctcctccccctcctccctgcaggcccaaggcgttggtaagggggcagctgagcaatggaacgcgtttccccctctcattattattttaaaaacagacacccagctgccgaggcaaaaaggagccaggcgctccctctttcttgaagagggtagaagttagggcgccggagcccgggcctggaacgccctcacccgcaacctccagtctccgcgttttgcgattttaattttggcgggaggggaagtggattgagaggaaagagagaggccaagacaatttgtaactagaatccgtttttcccttttcctttttttaaacaaacaaacatacaaaaaaaaaaaaaaaaaaaaaaaaaaaaaaagctaanaggcgacggaagccgaacgcagagtccggatcggagagaaaacgcagtaaggacttttagaagcaataaaaggcaaaaaaaacaaaaaacaaaaaaacaaacaaaaaaaaaccactactaccaataatcaaagacacaaatntntatgcaaggaggctccactgagcctcgcggcccggcccggccccgggatgccccgcccggcctgngggccgccccgcccgagcgcggatctgtgcactttggtgaagngggggcccgcgccgccccctccccctccccaggttcttacaatcagtgactcggagatttggggccccagtgccactgccctcccccgccccgtccccgttgngcgtcatgctgttttttaaaaacctgtttccaaatttgtatggaatggcaaactgttggggggtcggtttggggagggagggtttgcatgaaagacacacgcacaccacaccgcacgcacaagcaggcccggcgccggcgtccggggggcagaaggaggtgagctcgccggctcctcctccccgcggccattctgtcccctcctggggtgaggggtggggatggagacctgggggcagccccacccctgcccggactgtgcctcggtgggtgccacctggcgatttccggtgtctggagagagtattttttggtccaaggagtcctcttggctttagctggtgggtgggcggggagaggtctgagggctcctactggaggttcccccaaaaaggggcaaaaggagaccctctgcccaccggaggcaggggatcaggcatccaaatacacgatgcaaaaatgcaatcccacaggcgacacacccacacactcacccacacacacgcaattttaccttcctcttgtagcgaagatgaaactcccgtcggacacccgaagtgcattgcgtgtttctgttcagtttaatgacgattaataaatatttatgtaaatgagatgcaaagccggaccggtttctcacggtggcctcatttcattgaggggggagagaaggtttgagctggggctggggtgatgaaggcagagtgtcaagtgactgtgcagaggccaaacagagggaccctggacattcttgggtagtattctctccctaaccaccccccatacacccactgggctatactagctacccctcccagacccaacccaggctcgc

SEQ ID NO: 84616 - DNA, 2097 bp, Homo sapiens
gaattctaggcccagttctgtgtttcccctgtgtgttcctaggcaggtcagtttccctccatgggcctctgtaagatgaggagttggagaggtacattctcaggctactttcaactcccagccaagtgactcaagagtcccaggcagcaccagcacccctatctccaaggcctcctgatgtgtgtctctatttagaacttaatccaacctacccaacatcagatcagtgtcttaccagcccaaggtccctggggagcctcctagagggagagagccctgcccacccagattgagggtaaaggcctccccgtgctcatttttgtaccaccacagtgcttggcacatggtagacatcaaaatgtgtgtgctgaaagtataattgaagttgtgtatatatgtcagctagagtgtctggaggggcagaaatgtgggtctaaaacatacaaatgctccaaatggggtgtgggcaagggtctgtctacaccaggctgtgattacctgctcacatacatgtgtctatctgagtaggggtatgttatctatttttctacaccacagggtgaggaacaggtatatgtgtgcatgtgtatgcatccgtgtgtgtgtgtatgtgtgtgtgcatgagtgtgtgtgtgtgtgtccaaagccacctcttcaacctgtgccatttgtatctgtgtctggcccaatgagagtgttgaaaggtgagccacaagataaaacagcaacttcctacctcccttatcaagacagctgtctgacctacctccccttggccactcttgggattactggggttggcttcagtattttcagatttttcagaaggggaggagaatgcttgagtctcatccaggaacttaggcagttctcagcactgcctgctcctcctccctcaaataaccaagtctgaagaccaggagagaaagccgctggtggactggtcacctgtctggcagtgggaggaggagagtgagaggtttctaggtaggaatccagacttagaccctcccctccacccccagatgggtggtgcacaggctcatctcgcggcccctccccactccaccctaacatggatacgcccccaacaaccaaggaaagatctcccatcggctgactccacagatacacacatgtccccacagacacacacacgcccatgcagaggcacagacatccaggcacatctttccctttctctgtctttcccttggtttgaatttcgtttagccacatatgttgtgtgtgcgtgagggtgggtgggggaggggcagacagggatgagggatggcatggtgccaacatctacctatggggctcgggccagggacgccccttacagccatcctgggagggggtctcagctgtccctttgtggccaaggggaccctcctggggagtgggggcaagcacagaggtcctttctccccaacccggggtctggtccctgacccaccttgggggcctgcaggggaggaaatggacagagcgggaccctgagggagcatagaattggccaccacgagcccccagtgtccagccttgccaccccattgttcccgtgagggggtctctatatacagggggcaactcctcccaccttcctctcaatccctgctttccctgcgttgggcggggaggggagggcggcagaaatatttatttatttcctttatttatttaatttttttttttttttttggagtagagagtgacagatggcggcgggtcccgggggagccggctctcccccagtgcagacgcatgccaatcaccgtctctcatgtgatagctgctgcccgtgacgtgccaagcccatatggcctggcatagaggctggtaccccgcctggtagagatgccacactcgctccgcggttcgcatggcgctctgaagacgccggcgcccgccgccttgaggagccgctgcccccgctccctgaagatgggggaacaatgaaataagcgagaagatccctcttctcgcttatttcattgttgccgatcgcagggagcgggggcagggccgcaaggcgggggcgcggcgtttagagcgcatggaacgcggagcgagtgtggcatttacaggcggggc

SEQ ID NO: 84617 - DNA, 207 bp, Homo sapiens
ggagtggtagaacccagcatcttgtgaacatcagaccacagaaaaggcagcacttctgattcctgttcttagcctaggaactaggctttgcaaatggctctgaattttttttttttttttgagatggagtctcgctctgtcgcccaggctggagtgcagtggcacgatctcagctcactgcaagctctgcctcccaggttcatgcca

SEQ ID NO: 84618 - DNA, 1080 bp, Homo sapiens
tttgccattcatctattttgatcagttagttcctcaactttccttactactcccatctcctttgtaacatatacttctcagtaataaatggccagtgctctccagacatcctagcatcaacaacttctgggattgcagggtaccaaaaagctctgggggaacatacccttgtagaatccctcccacatccttgataacctgaggtgcagtaaactggggatgataggatgaatgccaggaaactaaaacaagtagggttatatttggtgttaagaacttgaaattgcatcccatatttggaaacccatgatccatccatcctagggctctcacttaataaccccagcatccatttatttagcactctctatactctgcaaagtgctctacatacataattttaattaatccccacagccttatgaggtaagtatcatactaattttccagatgggggactgaggttcagagagattatttttcctaaatcacacagaaactatgtatcttagaactggagtttgaacctaggtttctgacttctacattcctgtactccacctatcaagaagtacaaagaagggccttttcagcctagaaacacatgtgataaagctcctatgagattgtgctccttgttcatctgtcatctgctgtgctggtaaggtggctagtaatagtgggtacccaattaacatgctgaataatgtgaaaacgtgagtggaaaacaaaactttatttaaatggttgattcagaatgatgttttagaaataaatattaaatgctgttatgttttgattttccttcatttaaacttaaaacagttagtggtactgtcagcctttttgaggggcccatagtaggtgggctcaattaaaaattaatttgaattcaacttccacatttctatgtctgtgaccttttcttcctttatttcccctattcctgtcctttatgttttaatctctcccgccaatctccatttccttttattggttataagactgttgagttgaaggactcaaatcatttgaaaataaatattcccaagaaaaagcaggataacagaataaccagtt

SEQ ID NO: 84619 - DNA, 398 bp, Homo sapiens
  misc_feature (137)..(137): n is a, c, g, or t
tcagcttggttcaaggttcgcaaattagagcagttccttccagggtggttcacacttgagctggtgcccagttatgaattcagctcgcgggcctggtatttgtggcctttgccctccacagagccttcgcagccccntttagccctcacacgtttatcatcatctccctccaaccagggtggatatttggggagttagagaggctcttgctgctgcacagcagtacctcctgtctagcctggattaggggtccctggaggctcctctttggctgaggaggggctactagaagcaaacccactcagtcccttgaaaccctacctccctcaccctgttcaggcctgtgcccacatcatctggcctctgaggcctccctgatcattcttagaatagccatc

SEQ ID NO: 84620 - DNA, 1163 bp, Homo sapiens
gatcacttgagcccaggagttggaggctacagtgagctatcatcctgtctgtagtcccagctactcgggaggctgagtcaggagaatcacttgaacccaggaggcagaggttgcagtaagttgagatcgcaccactgcactccagcctgggtgacagagcgagactccatctcaaaaaaaaaccccaaaaaacaaaaaaccctacagtgtccggggctgtctggaaggtgacacccttaggtgagggtggcagagaaggctcaggatcatggccttggggctctctctggcttctccctgtggtccaaattttatcatgtaatgggcagcctcgggtgacccccaagaagaggtgccaaggcaccccctgacctgccttatacaggaacagaaaaaggcaaaagggatgaattttgctaaaaggatgccaaagccagagggaaaggagtgggactgacctgaggcagggccactcctccagatcggctctgtggttgccttcccttttaaatgcgcgttttcccttcacccatctgtccactccgattggccttgtttaaacagtgcttgtctcctctttctgtctgggggcacctttctctcttcctgcctctctgtttctgtttgcttctgtcattgtttctgtctttctgtttctctttctccttctcttcccatttctatctctgcctgactttgtctgttcgtctgtctctctgtctgcctcctgtctctctctcttcctttccatccctctcccccggcatgggcctctctcccatgctgccagcccctctgtagcccaccctgtggttctcttccatcagctgcttcctgcatgctctatggaggttttctgttgtttgaacaataaagaaagcttggctagtggaacccattgtttaaaaaggagaaaaaaaaaagagcaaacagaaatggccgtgcaagagccccctcccatccctgggatgagacaaaagccacattggccacccatctactggctcagagggggagcacagtttagggtcactgtctttcccccattctgcattcccaatgcggagaccttcttttcttttttattattgcattcctgtccctgagcactgagaagaagcccagctcgccctcgcccagggtccgtgacaaggcggcggccg

SEQ ID NO: 84621 - DNA, 833 bp, Homo sapiens
tgaacagttggagaaaataattttgttttgtatttgcatattttgctatatattttcttttttgttgattacaaaaattatacagatattatttagcttatcctcaggtattctgattagcttttttagctacactttcccatttacctaccttttagtcagaaaattatgttatacttttatgaattaactttgttattcaagtacaatttatttatttatttattattattttttgaaatggagtttcactcttgtcgctcagagtagagtgcagtggtacgatctcagctcactgcaacctccatttcccgggaggatcgcttgaatccaggaggcagaggttgcaatagctgagattgcacccctgcactccagcctgggtgacggagtgagactctgtctcaaaaaaaaaaaacacattgttattcggagtgttcagtcacaaggtcagcctattttatcaaaatgtaccagcaaaagattgttgttagcatatatgaaatttagtcacgatgtacactattttgtctctgtaagatttattcactgtgtatgtgtgtgtgtgtgcatgtgcgtgtgtgcatgcgcatgcgtgcacgcgcccgcacagaggatcacggtgaggtggtgggagcacccaggttctctctttcattgcaatgccgtttgttgcagcatggttcattgtaattgcagaggagaggacagtctcaatgaagagcgtcgatatgtatacaccacactgtagtatacagaggagaacactgtgctgtagaaagaatgaggtagatctaaatactactgcgaaacagtctccaggagagattcag

SEQ ID NO: 84622 - DNA, 445 bp, Homo sapiens
gggtcaggggtggcaagactcctaaggagggaaacgacagaaatgattctgttcttgcgagccccaaagcaagagtacttttctgatgggtaaagtggtatttctttccaggctgcaaagctctccacctttttcctttggtctcagtcagccccagccatgggggcaaatcaagttggggtcaactcggctgccagagacctaagttgccacaagggtcaccgacgacctaagcagcaagtttccttcgtccagcctcctgcccccacgcacattgcctccacagcaaactccacctgactcagcttgtttaactccaatcctgcagccctcccggcctcagcagggtcagggggcgcgggtctgcgccaagacggttaggaggcccaagtcctgggactggacggttactgcgctcccttgggcgcagccgctggcggcgtgg

SEQ ID NO: 84623 - DNA, 667 bp, Homo sapiens
cttgaacccaggaggccgaggttgcagtgagccgaactcgtaccactacactccagcctgggtgacagagtgagactctgtctcaaaaaaaaaaaaaaaaaattatttgaagaagtctaaattttctgacactgcttgtattataggtatatactacttaaaactctatgctaacatacacaaaaagcaacaaactactatatcagattatatatttatgtgctttaatttgtataaaatatattttgggggttgttatttacccttataattagatgaacttcttttgagaagttgaatgaaatgtaaaaaacatttttcaattttaagttatattttaagaacaccaagaattttgctgcagtggatccttctggtagagggaagattcagtcttttaaaattttattttagcatgctctgtgtccaaaaccctgtgccaggcaacaaaaaagacacataaaagtagccaacttggtccctgcccttgggcactcacagtcaaggtcatcagtattttaaaataaaatatcacctaacatagggaaataaaattatgatcccagataacagtagagaagatgagagaaggaccctagcagttaaaaaggtcaggagaggctttgtgagaagggaaacattaaatagtattaaagattatgtaaga

SEQ ID NO: 84624 - DNA, 392 bp, Homo sapiens
atctccaaagtgttgtctttttgtatgctaatgttcactgatagcttcaggatggaggtggtcaccagaaggacaaaggcatgattatagggttggaacttctgggcccacctccccaacttccagggagaagagcggggctgaaagacagactgatcagcaatggcctgtggtttgatcataatgaagcctccataaaaacccaagttgacagagtttggcaagcttttagatagctgaacacatggaggctcccagaggatggcatgcccagtgagggcatggaagcttcacacccctttcttcataccttaccatacacatctcttcatctatattctttgtaatatcttttataataaaccagtaaatgtaagtaactatttctctga

SEQ ID NO: 84625 - DNA, 172 bp, Homo sapiens
tgcacagaagaaaagggccttggagggcagagggcaggctatgaccagggccctgggcaagtcaggccaactcactaggggagggccacgctggggcggcagggtcaggggcttcagggggctcgggggacccaccagaagccatctgagaacagtgtccactggtcaagcc

SEQ ID NO: 84626 - DNA, 453 bp, Homo sapiens
ctcagtaaatatgttccagtttggagctgatctcaacaatgatgtgttatgccttagcatcagcctgaagcatacgcactgctgcagtgagccagtcttctgagctgtttcacccaggaatgcattcagaccaactgcagaagaatgaaagaagtgtcaaatagttaaagaatctagcccacacagaaagggagcttctggtcaggagttcttcagagaggatatggtgggtatttacttgggcctcaagggtccagcttcaggttctttgccatcagtggtggagaccagtgatacacagcaaggaacacgtcttggaactactgatcctgaccatcctgcccaagaactccaggcctgggtataggagcatcccagagtataggaaagaggctgtctgtactgaagaacttggagaggaagctgaatgatctgagaggaaaggtaaaatga

SEQ ID NO: 84627 - DNA, 591 bp, Homo sapiens
tgctacttaactctcactcaagccatgaagatgggacttggaggaaatccttatggaccagctggaactgggaaaacggaatcagtaaaggctttaggtggacttcttggaagacaagttttagtctttaattgtgatgagggcatcgatgtgaagtcaatgggacgaatatttgttggtttggtgaagtgtggggcctggggttgttttgatgaatttaataggctggaagaatctgtactgtcagcagtttctatgcaaatccagacaattcaagatgctttgaagaatcatagaactgtatgtgaactgcttggcaaggaggtagaagtaaattctaattctggaatttttatcactatgaatcctgctggaaaaggttatggaggaagacaaaaactgcctgataatcttaaacagcttttcaggcccgtagctatgtctcatccagacaatgagcttattgcagaagttattctctattcggaaggctttaaagacgctaaagtattgagcagaaaattggtagctattttcaatctatctagggaacttttgacacctcagcaacattacgactacggtttcagc

SEQ ID NO: 84628 - DNA, 1585 bp, Homo sapiens
ataacagcacttactactttctgatattgtcatcttgtttgtcagtttttctcttctagagaaatctttgtgagggcaggttcttggctctctactgattacttgagtctccattgcccagccttcttgttgtatcagttttaatatagcaaaccaaaataggatcttaattttaaaaaatagtaatgctacttaagatttgattactcttaagacctagtgtttctgtatgctaactccctttttataatgtaaaatgaattattctctcataatatttttctttcttttcttttctttttcttttttttttttttttttaaatgatttagatggggtctgcctgtgttggcccaggctagccacgaactcctgggcacaggcaatcctcttgcctcagcctcctaaagtgctgggattacaggtgtgagccaccatgcctgggcagtctcataataattttcattcctgactttttttcagatctagtctctagaaagaaacttgtgcataccaagacagtatggccaaaaacctatcctggcaagtgttaatgctatgtttccactcctgaacaccaggaactgaacattgttgtgtttgggtattgtgagtatggaagtcattcaattatttttcaaagcgggcttagtacatgatgttttgttaagctaccttgagaactggagtttgtgtttaagtttcagtgagataagggtagacctcctaatgcctgtgaaaattttgatatattttataatgtaccacctgacatcataatgtactgcctgacatccaaatcatctttttgagttttataaatctccaaacttcaaaactagtagatgctggtataaaacctaataatttcagttcaatctttacattctccagggtccacttttcattctcttaagtacaagcctatttctcagtttggcatagtgccaagaacattgataaatgttggccccaaaatgattgtcaaagttctgttcacttaaattcactgtaattagtaagaatagttatcatttattttgggtgccttcaaagtagactgtgctaggcaacaatttctcttgataatctcacaatagccttggcatttgaagaaactttggcctagaaacatttatgcccccaagatcacacaactagaaagaagcagaagttgatttatctcctaaatctatgtgacttcaaagctggtcatcctaccactatgcctggttgcctatatcatttaatgtgatgaaggcactaatgtgacacccacaccgggctcaatttattagtaatccttctatatcacagccacacaagtgcttagagttcctggctgagatcagtctatataattatattacacttctcaagtttagtagtgctagacaaataggaagggagttttacattctttgtttatttgcaataatttcatgattgtcgtaattaaactatagcccgagtttaaagaagaagccagccaaaaaaaaaaaattacccccttccattataaaaaatatgaggtccccacaaggggaccaatattcttcccaatttccaatggttatcctagcta

SEQ ID NO: 84629 - DNA, 223 bp, Homo sapiens
ctatttccagggtatttcggctattatgagtaaagcacatataaaaatttgtacacacagtcttagaggacataagtttcacttggctaaatgcctaggagtgaaattgccaggttgtacagtaaccctatgttcaattttataagaaattgccatacttctgagatgggagagttcccttgaccccttctcgggacttgcgacaggggtgtggcctacttac

SEQ ID NO: 84630 - DNA, 569 bp, Homo sapiens
ctcagcactctccaccccggtctgtggttgccacagtctcctaagtgctgtgagctccagcgctcacccagagatggaaagtttgcttctctttctacccagatgaggagatcgaatcccagagagaggaggtgatttatgtgagggttttgcgaggctggaagtcacgcccacagcctcttgccaggcagcagtgggggcctcagcccccaggcctctgccagagtggccccaaactgctgacttcagcatttcactggccagggcagatcagatttcttttctggcacttggccaccctgcacacccttcccccatcactattttgagctgagctcccctgtcccctcctcccagggctgtggccctcacacccaaagcctcactccaggctgaggcctttccacctcttgacccaccaccttccctccagccagggaaggctgggctggtcacggccatgtctatccaggccttgccagggacgccttcagacacagagccaggggccagctgccctgtgcaaatggcgctgctagctcaagacagccgtccagggtgctcagcac

SEQ ID NO: 84631 - DNA, 281 bp, Homo sapiens
  misc_feature (3)..(3): n is a, c, g, or t
  misc_feature (6)..(9): n is a, c, g, or t
  misc_feature (12)..(12): n is a, c, g, or t
  misc_feature (30)..(30): n is a, c, g, or t
  misc_feature (34)..(34): n is a, c, g, or t
  misc_feature (36)..(36): n is a, c, g, or t
  misc_feature (50)..(50): n is a, c, g, or t
  misc_feature (143)..(143): n is a, c, g, or t
  misc_feature (241)..(241): n is a, c, g, or t
  misc_feature (244)..(244): n is a, c, g, or t
  misc_feature (252)..(252): n is a, c, g, or t
  misc_feature (254)..(254): n is a, c, g, or t
  misc_feature (262)..(263): n is a, c, g, or t
  misc_feature (265)..(268): n is a, c, g, or t
  misc_feature (281)..(281): n is a, c, g, or t
acngannnnaanggaattatcgaatgaatngaananaatcatcgaatggnctcgaatggaatcatcttctaatggaaaggaatggaatcatcgcatagaatcgaatggaattatcatcgaatggaatcgaatggtatcaacancaaacggaaaaaaacggaattatcgaatggaatcgaagagaatcttcgaacggacccgaatggaatcatctaatggaatggaatggaataatccatgnacnggaaggcnanatcatcgnntnnnntcgaatggaatcn

SEQ ID NO: 84632 - DNA, 241 bp, Homo sapiens
aaagtcatgctctttgccactgtacttgtgtcaatgtttctcaaattttagtgtgtagcatccagaatccagaatcacttggatgtctcataaagacagatgaataggccccgccctcagtgtcagatgcattaggtgtgagatttttgcatttctaacaagttcccaggtaatgctgatgctgctgggctgagaccacactttgagaaccactgactatgtagtagtttaaattttgatg

SEQ ID NO: 84633 - DNA, 232 bp, Homo sapiens
gtgatctgcccacctcagcctcccaaggtgctgagattacaggcgtgagccactgcgcctggctttatgcatcagtttcctgatgctactataacaaatgatggctaacttagtgtcttaatacatcacaaatctgtctgacagagcagaaggtcgacgcagagcagaaggtcgacgcagagcaaaaagtcgaagcagagcacgaaggtcgacacagagcagaaagtcgacg

SEQ ID NO: 84634 - DNA, 445 bp, Homo sapiens
gggggctatacactgaaaatcactgttagaagactgctgaattggacaaaggcccctcaaaggagaaatgatccagcacttggtttttctgcttccctgaaaccctcatctcaacaaagatgccctgttatctccactgtgggtcctgaagccttagacaagtacagaagtgaaatgtacatctacataaaaaaatgatacacagtactaacttcatgcctgtgggtatagagccagaaatgtcacagcacacctgcatatctatcacattgtcacagcagcccctagatgcaattattcctgaattacagagaaacaaatggaggtaccaggcagctgtgactgttgtctacagagaagacacacgtggaaggcaatttttcttggtcatgaaaattgtcaaatgtacataaaggtgaaataaatagtgtaataaatccccaaa

SEQ ID NO: 84635 - DNA, 322 bp, Homo sapiens
tagatttttctgttctatttaaatagaaggtaaataaaagcatgtttatagaagcaggtaatggagatcttagatatctgaattagggataaatagatgtcccaacacctggggaaagttcatgtggcagtatatgcttcagaagactacagccatgtctatatgaagggcagatcttgtatctcttctcctgccccaatgtgggcatgctggcagggtaccaaaatcatctctttcttttgtacttgaaccatgtgacacttccttgggacaaaaaggcacttagagcataaaccaaatacaataggggtagagaacactg

SEQ ID NO: 84636 - DNA, 1027 bp, Homo sapiens
atggagaaagaatgaacttaaaagttgtacttcaatgaataccatcaagaaagtgaaaaacaaactcacagaatgggagaaaatattttcaaattatctatcttataagagacttgtatacagaatatttaaaggactattacagcttaataataaaaacacaacccaatttcaaagtggacagaagattcgaatagacatttattctaagaagataaacaagtggccaaaagtatatttaaaatgctcaaaataattagttattaaagaaatgcaaatcaaaaccacattgagcacatcatatccattaggatgactaaaatcaagaagtaaggcaataacaagtattgatgaggtaggttaggaactctttacacattgctgatgaaaatgtaaatgatgcagctcttttggaaaatagtctgacagttcctaaaaatgctaaacttagtattagcattttgattcagtaattccactgctaggtatatactcaagagaaatgaaaatatttatccacacaaaactgtacaaatgttcatagcaatattattcataatggcaaaaggtagacacaatccaaatgtccatcaactgatgaatggaaacataaaaagtggtatatgcatacaatggaatattattcagccattaaaaaggaaacaagtactgatacatgctccaatatggatgagcattgaaaatattttgataagtgaaagaagtcatgaaagtgtacataattgcatgattctatatatatgaaatgttcagagtaggcaaatatgtagagacaggaagtagatgagtagttgctgaggattggtgggttaggggatgaagccagggaatggagtcactgctaatgatacagaagttctttcaggttgatgaaatgttctgaaattgattatggcaatcattgcacaactttgtagtatactagaaacttttaaattgtacacttttaatcaatgaattgcttggcattatatcacaataaagctgttaaaaacaaacggaaggg

SEQ ID NO: 84637 - DNA, 366 bp, Homo sapiens
tttccccaggggagctggggaattcctgccaagcaccttgaataggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaaaaaaaaaa

SEQ ID NO: 84638 - DNA, 420 bp, Homo sapiens
ttttttttcagacagggtctcactctgtttgaccagactggagtacagtggcacgatcacagcccactgtagctttggcctccggggctcaattgatcctcctgtctcaggttcctgagtagctgggagtataggtgtgcgccaccatgcccagctaatttttgtattttctatagaaacaggatttcaacatgttgctcaggctaatctcaaactcctgggctcaagcaatctgcccaccttggcttcccaaagtgcacaggattacaggtgtgagccaccacacctggcctgcaatggatatttttaaataagcatcaaaggcaaaattcaattccagagaatccagaaggatgtggcgtcaggaagcagacataagaggggccaggaagccggcaggaggatgaggatgaacttggg

SEQ ID NO: 84639 - DNA, 389 bp, Homo sapiens
agacctcttaaactcaaaataggtatgtggatgttataatccacaatagatgtgtgaaaacctttcctgtactttttccattttagatgatattgaatacacccttttccagagggcttcaatagtagtagtgcttaatttcttcctgaagagtttagttttctgactgggtaggctcctttgttgtttcatgtgatgacatcattatctagtgttttcttttctcattcctgtgtaaaccaatgtctcatcacaccagaaaaacctgatcatatatatgctcgttttctgaataaaattcttctgggggcatttcatatataccagtaaggtccagtcttgattgtggtattacagaagcctccatgacttctccctcttacgttcta

SEQ ID NO: 84640 - DNA, 525 bp, Homo sapiens
tcagtaggaacccaagttgaaatgcctctgggggctggggcttataaacatgctcagggatgggagaagcaggtgaggcttgagcctgatgagcagggaggccagaaactgaatccggaagctacagtgagctgttctacctgcaaaaggaaaacgcaaaagaaccgcagattcaccccccaagacgagaagaggaagatggctgtgggtggacattgtctcatgaagacgaaactggggcctcaagcctgctttctaggttcccacgaggtacccaaataagaaccttccttgccagcaggggccttaacaccaaatcttcgagtttgagagcgccctctagtgttcatgcccatggcagtgttctcagttctggatttggggctcttgtaaacacagcttcttggtgatggtgaactcaagtcaaagggtacccactaatgaaacaatgaatggaactaagcgcatcagcagaacaatcagtgacagaatttggaccctagatccgcaaaatagaccaactcc

SEQ ID NO: 84641 - DNA, 1124 bp, Homo sapiens
catctgcgtcagcctcccaaagtgctgggattacaggtgtgagccaccacacccagacattcatctttatttttaaaggacatttttactgaacataaaattctctgagttggcagttttttctttcagcaatcttaagatgtttatgccttctggcttcaacagttggagcaagaagattgctgtaattcttatcttggttcctctggatatttttaaggttttctttctatcagcaatttgattacgatgtgcctcataaggatttatttgtgtttatcctgcttggggtttattgagctttgtggacttgtacatttatagttgtcactacagttggaaatttttaagccattatttctttaaatacgtttctatctcaagaagtacagttatctccaaatgagcgtcatctacatgtccacaactctgatcagaccactcttagagccagtaatgattattttaatacctaccatactttgtgtatatttactcctcagtaaatatttgtagagctgcacatagggaatttctttaacacctttaaagtttatttatttaaataagaaatacatgcccatggtaaatatttcaaatagtacaaaaatatttcaaatagtacaaaaaaggaggtattctgtgaaaagtaagtctttgtttcaccaaagataccaatccctgccccctccccgtcctaaggccatcactgttagcatttccttttttctcctcccaaaattgtctgtgcatgttcaagtatatatggatatatatccttgtgctagcatactatatacactgttctgcatctttttaaagtttaataatcttggcgatcattctatatcagtacatataaagtgggctttttatgaatggcctaacattacatcatacagatgtatcataatttaattaagtggtgccctgttggtggatattcaagtcgtctggtcttttgctattgcaaataatgttgcagtaaagtaaaatgtaaaataaaagtaaatgtcttacttacttaaaaacctattttaaaagtaaatgatggactttaggaggttaagaattaaaaattaataaacatataaataaatgaggtactctagcacttggggtca

SEQ ID NO: 84642 - DNA, 638 bp, Homo sapiens
catctgcgtcagcctcccaaagtgctgggattacaggtgtgagccaccacacccagacattcatctttatttttaaaggacatttttactgaacataaaattctctgagttggcagttttttctttcagcaatcttaagatgtttatgccttctggcttcaacagttggagcaagaagattgctgtaattcttatcttggttcctctggatatttttaaggttttctttctatcagcaatttgattacgatgtgcctcataaggatttatttgtgtttatcctgcttggggtttattgagctttgtggacttgtacatttatagttgtcactacagttggaaatttttaagccattatttctttaaatacgtttctatctcaagaagtacaggatgctcttggtgtcttcacggggattggttccccgaattcccctggtgtacccaaatctgtggatgctccaatcccttatgaaatggcatactatttgcatgtaacccatgcacatcctcctgtatactttaaaccacctcactttgggaggccgaggcaggcagatcacgaggtcaggcagattgagaccatcctggctaacacggagaaatcctgtcgctacttaaaataccaaacaatttat

SEQ ID NO: 84643 - DNA, 1763 bp, Homo sapiens
ggagccacgccccgcacagttaacagacgggcgctcagggagctagggagctgtgaagctgctggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgatgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgtataaaaaaaaa

SEQ ID NO: 84644 - DNA, 864 bp, Homo sapiens
ggagccacgccccgcacagttaacagacgggcgctcagggagctagggagctgtgaagctgctggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaaggtaagctaaggatgaagcaaagtaagaagtagaagacaaacttcaaagttatttaaaattttttaatcttaatctttattagattttaaatattcaaagtacagagaaagagtgcactatgtattaaagctgtttatgttcaattttaacagaagtctattatctttaacaaatagatc

SEQ ID NO: 84645 - DNA, 1709 bp, Homo sapiens
ggagccacgccccgcacagttaacagacgggcgctcagggagctagggagctgtgaagctgctggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgatgttcataatggaattgcagaactcttagtagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgtataaaaaaaaa

SEQ ID NO: 84646 - DNA, 688 bp, Homo sapiens
atattaaaaagaactacacatatcttttaagctcatgtagaaatttatcctgatggcttgaaatagctactgaattaggtaccatgtgtatatttgttattctttgccttttaaataatcttcccttgccttttaaataatcttcccctctcccctatagggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgatgttcataatggaattgcagaactcttaggtaagtaagatctaactggatactagcatttatcttttggaggaaacaagaaaaagttagttctcaaactgaaccagaatagtactactacaagctgggagtggatctggattaattcatggaaagtatgtttgttcaaaaacttctaggggtcatttggaaagaggctttaacaagctctgaagttatgcagaaacttctggttacccaggagtataatgctgctctcattcaccggaagcttaagcataaagcagcaattctctttttttagaagagttatcagcaccaccattactcccctttcaatctcttc

SEQ ID NO: 84647 - DNA, 1554 bp, Homo sapiens
ggagccacgccccgcacagttaacagacgggcgctcagggagctagggagctgtgaagctgctggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgatgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgcc

SEQ ID NO: 84648 - DNA, 2101 bp, Homo sapiens
ggctgggtcccggcgcggggcgggcggcgtggggcgttcggccgcctgcgcctgtcaacggccggctgggcgagcacagcacagctgcgaccacttggccaacgcccccgccgagcgggcggatcgagttcctctctggctggtgggctgcaagcggcagagcccgcccgcacagcccagcttttttctttctacccagactctcaacttgaccgcgcgttggtctgtgcgcccgctaacgtgccaggcacgcgccggggagctccgggatatgctccgcggtgctaccggtgacaagtgtggtatctggaatttgtgtagttctttgccccctgtctcaaccacaaaccttgacgacacagtatggccaggggccgagctcctcccttgcccactttgttctccagactgctaggagtcaagagtcagcttgtctccccagactcttcctgggagggatgagaggtttatgtgagttctactggcaggaatttggcataaaaggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgatgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgtataaaaaaaaa

SEQ ID NO: 84649 - DNA, 346 bp, Homo sapiens
tattacatgatatatctttattcactcaacattaattgagcatctaatatacagaagacattgtgttgctgatcacttgaagaatgcaaaggtagctttttaagagctactctatttgtacttcatgagttcagctctaaatttcttttattcagcattttacatcatctacctcaaattattcaattggagtaaagtgttacatacatgctaaagcacaattaaatatgtgaaaagattcagttagcaaaaaataaagaaaaattggatttaaaatagtgcacattgataattcttaaaatattctattctattctgattatatcagccatctaagtcactcagt

SEQ ID NO: 84650 - DNA, 84 bp, Homo sapiens
gaaagaggagactcctgccctcagcagtcccaggcccagaacacaggccgctgggagatgacggcggtgtctgcgtgggtgtgc

SEQ ID NO: 84651 - DNA, 405 bp, Homo sapiens
gaatgaaaatggcatatttgaacataaacttagggcagatttttactacttttgaaaaaatgttggaaaatatttctgtatgaaacgtaaaacaacttttaattttttttagaagttgagaggattctattttgcaaagctgtattatgaagctaaagaatatgatcttgctaaaaagtaagtacaaactgtaacatgtattctttttttaaaatcaatgccttttctcattttcttctttgaaataggtaaaaatatgttcttagtagttcttcctaagtgtattctggaataagggatttatcactcagactgatgctaaggaccagcctagattccattgagattgaaaccgtaattagtgttttctgcatgctgctgctttataccaagggcaagaaattg

SEQ ID NO: 84652 - DNA, 824 bp, Homo sapiens
tctgttcactcatgtgtaaaataggggtaataattgtaaattacttcatagaattcttgtgagttaaagtatgtaaaaacgttattattgtgcctggcacccagtaagcattcaaaaaatgttagctaattaacctctgatattaccacatactccagtgaggtatgcattctctgtttttcttttaagtctttaaatagaacagtcataagacttgacttgtgcctttttggattaatgaacatttttaggactggtagcttttagaaatggctttatgaggttatctatgtcgtatccaaaaagtagagatgctagaaaatttcatattattttgtgctctggcctttgttcataatccaaacaaaatacaatttcctaaactttattgtttctatcataagaaataaaatgtaatacacttaaataggtagcaacaccaaatactttaattaatattttatagaatacacaactgcatctttttgtcatagtattaagaggaaatatgtgtagcataagtgtcaatcttgctgtatttttattaaaaccttgacaatctgaactgcagataactttatttaatagaggcatcattgttattattgccaaacctcttctcactgcacagtaggatccagctgcaggaagttagctgtgactggggctgatgtctatgaagtacatctaatccatctcatcaagtttatagaggacttgaagtgtagccaagaaaattaatgagtggcataattgagcagactcagctgtggagtgatcatgtttctttccacagtatttctgcacttgagtgtattgcatca

SEQ ID NO: 84653 - DNA, 629 bp, Homo sapiens
ggatttgctcctgggtgtccagcaggaaggagactgtgtgcacctcgcccgactgcggccggagcgcggcgctgacttttccaggcggcgggggtccgtctgtcccggcggcggacggacgaaggacggacgccggagaaagagggcggcggcctgggccgaggcgggtccccaactccggcggcggcggcggcggcttggccttgggggcgggcatgagcccccgggggccgagtggtggccgccagggctgacccggcgcggcaagcggcccggcccagccatcttgactgcgcaccgcggccccagaggaaacttgcggcgcctccgccctctctgtccggcggagtcaccgccgcccggcgcggcggggagaagtggtcgggcgcgcggagaggaggcgagcgagcgcgggacgatgagccgaggcccggccgctctgcgccgcgagggctgagcgcgacccggggccagcagagcggacctacggactgtggcgcgcgcctgcagccgccttcaaacccccggagcggcggaaaggagtgcggaagggccctgcccaggctgcgggccgcgccgctgcggacgcgcccctagaaggggttagattatcggcagacccccctccc

SEQ ID NO: 84654 - DNA, 780 bp, Homo sapiens
acaacacctacctccttgtaatctccatttgcatacattggtctctaatgtgtcatgtaaacctacacataaatgaatctaggttgtttttgcatccacatgtcagccttgcttaaagaagaaaatatccctctgtcaatatccaacccagaatgcggtagagtattcttggctacagttcttcacccctccctactttcatgacctttgctgtgtgatttttcagtacctctcaataaagtggcagagtatgtttttctgactttttgctgtaatgtatattgcctcaactgatacagtaaagtcacctctaggtaacctaggtcttaggaggtttatgtgtttccgcttgtcttcttgccattgccgtgaaaagagctcccccatgtgcctgattttctcttagttttggcttcagattgaacacatgaggagctcagacctcagggagtgccaagcccagctctttgcatagctagaacagagtacaggaagcccagcctagatcagccaacttccagcgaaaccaaaagcacatgagctaagtaatttcttattgttgtatgatgttgatattttgtagttgtttgttatgcagcattactataccagtaacaaactggtatcaagaataattgcccatagacctgatttccttcaactattcttggtatatcataattcccatttcaccaaatatcttagatgttttcttctgaaaccattccagtggtcctagtgttcatcttaaagttgggctcagtgatcttgagatatatc

SEQ ID NO: 84655 - DNA, 246 bp, Homo sapiens
tgaagtgtaatttatctcatttccttttgtcacttgtgcttttggtgttttatctcagaaaccaaggtcacaataatttactcatgttttcttctaacagattgtatggttttagatctttaggtatatgatacatttttagttccttttttgcatggtatgaggaagtgatatatattcattcttttgcatgtagacactggttgtcccaggacaattttttgaaaagactattcattaccaatt

SEQ ID NO: 84656 - DNA, 706 bp, Homo sapiens
ggggaggtagctcaccagctccagggttccctttttgagcctcaaatcacaggactgggtgtgccgaaggtgatggcctggtgcctggcgctacatcacccatcacccatcacccaggcaccgcctggtgcagagctgggccagggaggcttccagaggaggcagatggggcaggagcagggtgatcacagcacatggaggcctgagcttctcagggacagtaggaggcgttcctccccagagcccgcaggcacctgctgggtgctcactggctccagacgtggatctgcagctgggaatcaagtgatcgagaccttcaattctggcgggggtggggatgggtggcgacagtaaccaaattcacaagatatttatagattgtcagaagtgtcatgaagaaaataaaacaagggatgtgacagggagtgtcaggggagtgcaggggcgatggctgcatttaagctccttctggctgctctgtgcaggaggaggactcacaggggtggctgtggaggcctggggccagagaggccactgtccccaggggccaggctacagtctacgaagcagggagggcttggagccatgaagccagagaggtggaggctgggggccaggccaagaacaggaggggagtcggagcagagccaagctggactccctgtgtctttgggactctgccttgatactgccatcggtaacccac

SEQ ID NO: 84657 - DNA, 368 bp, Homo sapiens
gtccctgtcaaaacatgggaaaacatttctatttaaaaaggtcacatatcatgtcaaatgacggatgtaagagtgacattttaaacagccctaattccctttagctatcaaatttctaatggagctcacgcaatagctatagcttctataacttactcttcctcttctcaatgtttcctcccttattatcataaaaggtctcctaagcatcctcctccacccctccccctcagctctttcttcctaatgattatgaggatctgggtgcagaggcattcacctgtaatcccagctatgtgggaggctgaggttggaggattgcttgcgctcaggagttcaagaacagccggtgcaacatagtgagaccc

SEQ ID NO: 84658 - DNA, 649 bp, Homo sapiens
tcatagtctggccacagcctaatttcccagtgttattttcagttattctctcccatgactcctagaaacacccttgaccaaacgttgtgtctttgatcggaaatgctgtctattgaaatataccttttattttcttgagtggaccttaaacctaatttttgtctgaatgaatatcagagtttctgtatatagtgttgagaacacataattcaaggttcaagaatgtagtattgaaatttttactattttatctttatcaaaagcctggttgcaaaaacaaaatcacctaaagtaatgaaacttttggaagacttcctgaaggccatgttatcaatccattcttccatacatccttaaatgtaccattgtgtatccaatttttgtctagtataaatatattgtgcatttatatttgatcacagtaactcaggattcttaggatgggattagtgggtgaaaatgtatgaatatttttgagactgttgatacatatagttaaattgccgaaaaagatatgttattttacatgccaacttttaatacatatactatattgcatgttactaaatgtgtatagtgaatacttggttaaataaattagaaggacttcacttatctaaaataaaaaatcctttataagttacctgat

SEQ ID NO: 84659 - DNA, 875 bp, Homo sapiens
tcagcctcccgagtagctgggattacaggcacccgccgccatgcctggctaattttgtatttttagtagagacagggtttcaccgtgttagccaggatggtctcaatctcctgaccttgtgatccatctgccttggcctcccaaagtgctgggattacaggcgtgagccactgtgcccggccttcttttttagaatgtgtaaactagacacaatttttctcatgtcatgcacataaaagcagtattttccagcagtggtcgctcactctccttgctgggcagacagtcagtgtatccagggtgcagtgattttggagtatccaggtgtggatgaactatttacttgtggttggagtgcttcccagattctcatagccaggggcccaggcatggtggctcaagcctgtaatcccaacactttgggaggctaaggcaggaggatcacttgagtctaggaatttgagactagtctcagcaacatagggagaccatgtgtctacagataattttaaaaattagttggggtagtggtgcacgcctgtagtctcagctattcgggaagctgaggtggaaggattgcttgagcttggcagggtgagattggagtgagccatgattgtgccattgcacgccagcctaggcaacagagcaagaccctgtctcagaaaaaaaaaaaaaaaattagccaggcatgctgacatgtgcttgtagtcccagttactgggtgggaggataacttgaacccaggagtttgaggctgtggtgagctatgatcatgcctctgtactccagcctgggtgacagagtgagaccctgtctcaaaataaataacagtgtaagttaaataataataaagagattttctcctggctctg

SEQ ID NO: 84660 - DNA, 449 bp, Homo sapiens
taatgacaatttatagttggaaaactagaaaatatcataaaatacactgtactgtgataagttctaaaagaaaactgcctaaaacttaataatctgaatctatacatggtttgttcttattatattttataggtcacctgaatatctacattaacttttagcaaagtttatacacttgaatttcttctttgcaggaaaagaggagtatcatcatagaacaagtataacatatataaagataacttcaaaatcataaaaatactatattaaaattcataaaataaagatctcatcctttctaatccatatctaaacgtgcttccaactaatagggtaattacttataaagcttcccaaatgagtttccatttttgagctgagatgagggtatatatatcatttgacccaggaagagaaaatattttgtataataatctaatgtgattaag

SEQ ID NO: 84661 - DNA, 1070 bp, Homo sapiens
tcctctgtcttaattttagcccagaaagacccatgttggacttctacagaactgtaagataatacatgtgtttttttttaagtcactaagattgtagcaatttgttactgcatcaatagaaaactaatagaacaaggtatttcccaacagctgagtgcaagtttatggagaaggtttcatttataagctgttagcagcagcactcccagaaattggaggatgggtgcactcgtcattaaagggttggcagtgttcactttagtaaatctgcctaattctgggatgcaatttaaggaagcctactgtttgtgattttggttgcttttttgtttgtttgttttggttctttttagagagctattccttacctcaaggtaaaaaacatattctcttacatgttctttaaatacaattttaattgggttttatacatataaatatttaatccatcccttctgaaatttgtgtgtgtgtgtggtaggaagtagaaatttacctttttccagatagatagcaaattgtctcagtctcatttattgaggagtcagtcttctttccctattgatttgaaatattataacccaaatttccacaaatgcatgggttagtttctgggcactagtgatttgctcacctaatcccaaatcagcaccacacttatttaattattatagctttacagtatgacttcatatcttatgagtaaaatttgttctcttaaaaaattgtcttggctatatgagggtattggtgatgttgactccatctcttatttaaatatatatatgtaaatatatatgtaaacggctttattgagatataatttacacatcatacaattaacccacttaaagtgtacaattcagatttttagtatactcacagacatgtgccagcatcactgcaatcaactttagaaaccctttaccaaataacatcctatgaagaaaccctgaaagaaatccctcattctcccctccccctgagcccctggcaaccactaatgtactttctatctgtatggatttgcctgttccagataataaataaaaatggagtcatacagtgtg

SEQ ID NO: 84662 - DNA, 316 bp, Homo sapiens
tacatggcgggagcaggagcaagagagacagtgggggaggtgctacacacttttaaacaaccacaactcactatcatgacaatagcaccaagaggatggtgctaaaccattcaggagaaaccacccccatgatccaatcacctcctaccaggcccctcctccaacactggggattacaattcgacatgagatttgggcgggaacacagatccaaaccctatcactcacccagggcagcgttctcctgtctgcatggccagcaagaggcagactcaggactggatctcaagtctctcttctctgtcctttgctacct

SEQ ID NO: 84663 - DNA, 562 bp, Homo sapiens
cccagcactgtgggaggctgaggcaggagttccaggctgcagtgagctgtgaccgcaccactacattgccagcctgggtgacagagtgagaccctgtctcaaaaaaagaaaaaatattgccaggaggtggagaattcagggtcacggcatcatggggacccacctagcaggctctggggcccttgtcccacccctgccaaggcccctctagccatgcagggtggggtgggattttccttcgtcctctcccaccatcactccgggagacagggggcctgaagtgcaggcgggagggctgctgtgggcatttgtgaagggtgcaggaggtgtttaagggaatggagagtgcacttccctacctacccagagggctctgggactgcccccacccccagtactcaccagaatcccgggagagagaagctgaaagcagggcaggggcacatcacagcactgagcgtcctgggccccggttcctgttccacctgccagagaacccgtgttcaacatcagaaggggcgttggcggggccctgggccaggcctgcctggatgcgcggccg

SEQ ID NO: 84664 - DNA, 888 bp, Homo sapiens
actgttgtgtagcacagagcctggtacagaatcatgctctgtaaatacctgctggatggtcgggtgggtcacaggtcagtggttgtgggcaacttgtgaaagttcagttggatgccagacccagccagcagagctgaattcaacatggaagccactttgtaaatggcagtgtccgatgggtttcagcctgaaaatgggagctgtggcaacactgccagctccccgcagggacctggcacccctagaaatggggttatcgtctcagccggcctcaacccactttctcgtccccagcaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatgtaagtagtgcccggctggtgggaggaccagtctgtccagagtcaggtgtctcagctctgggaaggggctcagcaggggcaccacggagggcccaagccttcccctaggaagcagaagggccaaagttcccataaacatagccctggcgattcttagcatgtggctgggcctgagcccgccccacacctgagctccagctggcaggggtcgagggcctcacgtgtcccaggcatcagtgacctccccttgccattgctttttcctgttggctgccttttcctaccaaattccacttggcaaagagggaacccagctctttcaagagggacatcaactcctggttgttcaggaattacttggccctccttggctatcggccattcccagct

SEQ ID NO: 84665 - DNA, 4895 bp, Homo sapiens
  misc_feature (970)..(970): n is a, c, g, or t
  misc_feature (2323)..(2323): n is a, c, g, or t
cccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaagcaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattggcgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaanggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttganttcaactatggcgtgtgtgtcatgaggatgcgggagggactcaacgtgtccaagatgatgcaggcgcacattaaccccgtgtttgacccagcggaggacgggaaggaagccagcgccagaggtgccaggccatcagtctctggcgctttggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttatgggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacaccagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaaaacaacaaaacagagacaaaacaaaaacaaacaaacacaaagagaaacaaaaacctgttgtgcgcgcggcgccctcaggcccacgagaaacaaagctctctccaacacacccattgccgttgtgggcgcgccgcgggcccccccaggagaggtcagcgcggacaccacgtgtgcgccaccagcgtgggtctcccaaaagggagaaaacacccacgaggcggacaagaaagacaacaggggcgccggagggaattcaccgcaccccaataaatacaaaaaacacgcgcccggggggcgcggcaacccaccaggagcgcggttcctctgggcaaacaaacatctctcacaaagataggacgactccccagagacgagggcgacaacaataacccgggggagactacatcatacaacacaacggggggaggaggtctacccaaagggacgagaggcctcccggattatcatccacaaaattataagcgccgcccccggctcccgtcggtgggtgaactcaccgagcagagcaacaccacaccacacacagcagcaaccagcgagacagaacacgaaacaagcaaacaaagacgaagaactacaacagacaagaacgcgaacacaccaacacagcaaacaaccgacacgaaaacgacggtgag

SEQ ID NO: 84666 - DNA, 4868 bp, Homo sapiens
  misc_feature (970)..(970): n is a, c, g, or t
  misc_feature (2323)..(2323): n is a, c, g, or t
cccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaagcaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattggcgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaanggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttganttcaactatggcgtgtgtgtcatgaggatgcgggagggactcaacgtgtccaagatgatgcaggcgcacattaaccccgtgtttgacccagcggaggacgggaaggaagccagcgccagagtggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttatgggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacaccagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaaaacaacaaaacagagacaaaacaaaaacaaacaaacacaaagagaaacaaaaacctgttgtgcgcgcggcgccctcaggcccacgagaaacaaagctctctccaacacacccattgccgttgtgggcgcgccgcgggcccccccaggagaggtcagcgcggacaccacgtgtgcgccaccagcgtgggtctcccaaaagggagaaaacacccacgaggcggacaagaaagacaacaggggcgccggagggaattcaccgcaccccaataaatacaaaaaacacgcgcccggggggcgcggcaacccaccaggagcgcggttcctctgggcaaacaaacatctctcacaaagataggacgactccccagagacgagggcgacaacaataacccgggggagactacatcatacaacacaacggggggaggaggtctacccaaagggacgagaggcctcccggattatcatccacaaaattataagcgccgcccccggctcccgtcggtgggtgaactcaccgagcagagcaacaccacaccacacacagcagcaaccagcgagacagaacacgaaacaagcaaacaaagacgaagaactacaacagacaagaacgcgaacacaccaacacagcaaacaaccgacacgaaaacgacggtgag

SEQ ID NO: 84667 - DNA, 2451 bp, Homo sapiens
gacatctactggctctttgacgatgtctatggtcttcttgccctgctccgactggaagatggtggtggcctgctcctccttcaccaggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttatgggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacaccagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaaaacaacaaaacagagacaaaacaaaaacaaacaaacacaaagagaaacaaaaacctgttgtgcgcgcggcgccctcaggcccacgagaaacaaagctctctccaacacacccattgccgttgtgggcgcgccgcgggcccccccaggagaggtcagcgcggacaccacgtgtgcgccaccagcgtgggtctcccaaaagggagaaaacacccacgaggcggacaagaaagacaacaggggcgccggagggaattcaccgcaccccaataaatacaaaaaacacgcgcccggggggcgcggcaacccaccaggagcgcggttcctctgggcaaacaaacatctctcacaaagataggacgactccccagagacgagggcgacaacaataacccgggggagactacatcatacaacacaacggggggaggaggtctacccaaagggacgagaggcctcccggattatcatccacaaaattataagcgccgcccccggctcccgtcggtgggtgaactcaccgagcagagcaacaccacaccacacacagcagcaaccagcgagacagaacacgaaacaagcaaacaaagacgaagaactacaacagacaagaacgcgaacacaccaacacagcaaacaaccgacacgaaaacgacggtgag

SEQ ID NO: 84668 - DNA, 2037 bp, Homo sapiens
gtggaaggagctctgagggacggtaaacagactcgctgttctgaaaacaaactgggagctgggcgtgtggagcggccccgtggtaatctctcttctaccactttttcatgccttgcagcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttatgggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacaccagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaaaacaacaaaacagagacaaaacaaaaacaaacaaacacaaagagaaacaaaaacctgttgtgcgcgcggcgccctcaggcccacgagaaacaaagctctctccaacacacccattgccgttgtgggcgcgccgcgggcccccccaggagaggtcagcgcggacaccacgtgtgcgccaccagcgtgggtctcccaaaagggagaaaacacccacgaggcggacaagaaagacaacaggggcgccggagggaattcaccgcaccccaataaatacaaaaaacacgcgcccggggggcgcggcaacccaccaggagcgcggttcctctgggcaaacaaacatctctcacaaagataggacgactccccagagacgagggcgacaacaataacccgggggagactacatcatacaacacaacggggggaggaggtctacccaaagggacgagaggcctcccggattatcatccacaaaattataagcgccgcccccggctcccgtcggtgggtgaactcaccgagcagagcaacaccacaccacacacagcagcaaccagcgagacagaacacgaaacaagcaaacaaagacgaagaactacaacagacaagaacgcgaacacaccaacacagcaaacaaccgacacgaaaacgacggtgag

SEQ ID NO: 84669 - DNA, 1070 bp, Homo sapiens
ggacaggtggttttttcttgtgacggtggtgcctgagtaactggagttgggaactggaggggcttggccgtgtcaaagattccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaaaacaacaaaacagagacaaaacaaaaacaaacaaacacaaagagaaacaaaaacctgttgtgcgcgcggcgccctcaggcccacgagaaacaaagctctctccaacacacccattgccgttgtgggcgcgccgcgggcccccccaggagaggtcagcgcggacaccacgtgtgcgccaccagcgtgggtctcccaaaagggagaaaacacccacgaggcggacaagaaagacaacaggggcgccggagggaattcaccgcaccccaataaatacaaaaaacacgcgcccggggggcgcggcaacccaccaggagcgcggttcctctgggcaaacaaacatctctcacaaagataggacgactccccagagacgagggcgacaacaataacccgggggagactacatcatacaacacaacggggggaggaggtctacccaaagggacgagaggcctcccggattatcatccacaaaattataagcgccgcccccggctcccgtcggtgggtgaactcaccgagcagagcaacaccacaccacacacagcagcaaccagcgagacagaacacgaaacaagcaaacaaagacgaagaactacaacagacaagaacgcgaacacaccaacacagcaaacaaccgacacgaaaacgacggtgag

SEQ ID NO: 84670 - DNA, 484 bp, Homo sapiens
gcggccgctggctctgctctgacccgcccccacctcctgcagtggaccccaaggccctggtgaaggaggagcaggccaccaccatcttccagtcggagcagggcaagaagaccatagacatctactggctctttgacgatggaggtcagtgacccccttggatcagccctcctgcccggcgggggcggggtggtggtggtcttccttccttctccttcctggcctgctctcaaaggggacaggggctcctgggcccagcagtgagctcaggggagcccagagggacccctctgtctggcctctagttttttggttataaaatgggaagctttgagagaagagctgaagtcgccatgagatggaaacttctgactggatggcccttaggggcacaggcaggtgatataaatggggagatgggcggtgcccaggaaagctggaggaatatttttcacttcacaatgaaatataacctctcccatta

SEQ ID NO: 84671 - DNA, 452 bp, Homo sapiens
cgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaggcatggccacctttctgttgtgccttgcatttgtccacacacagggagtctggctgagctggggaaaggccacggctgggtgtcattgccattttcccagctcatctcaccgggaagaaaagcagattgacagaacacgtgaggaggggtattgatggcaggagagtc

SEQ ID NO: 84672 - DNA, 504 bp, Homo sapiens
actgttgtgtagcacagagcctggtacagaatcatgctctgtaaatacctgctggatggtcgggtgggtcacaggtcagtggttgtgggcaacttgtgaaagttcagttggatgccagacccagccagcagagctgaattcaacatggaagccactttgtaaatggcagtgtccgatgggtttcagcctgaaaatgggagctgtggcaacactgccagctccccgcagggacctggcacccctagaaatggggttatcgtctcagccggcctcaacccactttctcgtccccagcaccaagaggtttgaggacatgattgcacccttccgtctgaatgatggcttcaaggatgaggccactgtcaacgagatgcggcgggactgccctgggattacaggcgtgagccacggtgcccagctgcagatagtgatataatttatagtgtagtcaattgtgttgaactgccgcttgcaacattttcttgtgtgacttaaggcattaga

SEQ ID NO: 84673 - DNA, 3313 bp, Homo sapiens
  misc_feature (768)..(768): n is a, c, g, or t
aagaattagcatggcccctgcgcaaggatgacacgcaaattcgtgaagcgttccatatttttcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttganttcaactatggcgtgtgtgtcatgaggatgcgggagggactcaacgtgtccaagatgatgcaggcgcacattaaccccgtgtttgacccagcggaggacgggaaggaagccagcgccagagtggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttatgggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacaccagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaaaacaacaaaacagagacaaaacaaaaacaaacaaacacaaagagaaacaaaaacctgttgtgcgcgcggcgccctcaggcccacgagaaacaaagctctctccaacacacccattgccgttgtgggcgcgccgcgggcccccccaggagaggtcagcgcggacaccacgtgtgcgccaccagcgtgggtctcccaaaagggagaaaacacccacgaggcggacaagaaagacaacaggggcgccggagggaattcaccgcaccccaataaatacaaaaaacacgcgcccggggggcgcggcaacccaccaggagcgcggttcctctgggcaaacaaacatctctcacaaagataggacgactccccagagacgagggcgacaacaataacccgggggagactacatcatacaacacaacggggggaggaggtctacccaaagggacgagaggcctcccggattatcatccacaaaattataagcgccgcccccggctcccgtcggtgggtgaactcaccgagcagagcaacaccacaccacacacagcagcaaccagcgagacagaacacgaaacaagcaaacaaagacgaagaactacaacagacaagaacgcgaacacaccaacacagcaaacaaccgacacgaaaacgacggtgag

SEQ ID NO: 84674 - DNA, 1991 bp, Homo sapiens
cacatgaaaaaaagatgcccaggagaattcaaaaggcaccagcaccagttactcttcattgacaggacagagcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttatgggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacaccagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaaaacaacaaaacagagacaaaacaaaaacaaacaaacacaaagagaaacaaaaacctgttgtgcgcgcggcgccctcaggcccacgagaaacaaagctctctccaacacacccattgccgttgtgggcgcgccgcgggcccccccaggagaggtcagcgcggacaccacgtgtgcgccaccagcgtgggtctcccaaaagggagaaaacacccacgaggcggacaagaaagacaacaggggcgccggagggaattcaccgcaccccaataaatacaaaaaacacgcgcccggggggcgcggcaacccaccaggagcgcggttcctctgggcaaacaaacatctctcacaaagataggacgactccccagagacgagggcgacaacaataacccgggggagactacatcatacaacacaacggggggaggaggtctacccaaagggacgagaggcctcccggattatcatccacaaaattataagcgccgcccccggctcccgtcggtgggtgaactcaccgagcagagcaacaccacaccacacacagcagcaaccagcgagacagaacacgaaacaagcaaacaaagacgaagaactacaacagacaagaacgcgaacacaccaacacagcaaacaaccgacacgaaaacgacggtgag

SEQ ID NO: 84675 - DNA, 3113 bp, Homo sapiens
gcggaaacatggcggcgggaagggagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84676 - DNA, 3532 bp, Homo sapiens
gcggaaacatggcggcgggaagggagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagcatctagtgctttttgcatggcccaaaggggctctgtgctgctccactacagaggaaacttcaagaaatgctggtttgctacagtgttttagcttgtgagattctctgggaccttccctgctccatcatggggtcacctctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccaggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84677 - DNA, 2912 bp, Homo sapiens
gcggaaacatggcggcgggaagggagtgagccgccccgcgcccccgccgcgccctcagtgatagactggagtgatgttagaaaacacaaatatggtcacctatcagagtctgcatcccaatatcaagaagctgctgacatcctggatctagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84678 - DNA, 3781 bp, Homo sapiens
gcggaaacatggcggcgggaagggagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagcatctagtgctttttgcatggcccaaaggggctctgtgctgctccactacagaggaaacttcaagaaatgctggtttgctacagtgttttagcttgtgagattctctgggaccttccctgctccatcatggggtcacctctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtggaccttcgtgggaccacagcttaaacttcaaggtgtcaggaagacctccaaggctctcctcatccaaaagagatgcacctgatactgtccatcttaatatcctgtttctttcctttgttataatagttgctaatatttttagctacctgtattttgtcatctgcctcactatagtaaatgttccatgaggatagagacaatatctttttcaccattctcagtatccatcatcctaactgtcatatggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccaggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84679 - DNA, 3549 bp, Homo sapiens
gcggaaacatggcggcgggaagggagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagcatctagtgctttttgcatggcccaaaggggctctgtgctgctccactacagaggaaacttcaagaaatgctggtttgctacagtgttttagcttgtgagattctctgggaccttccctgctccatcatggggtcacctctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagaaggaccattttggcaacaatgaaaggacggattcagatgctggagtcagggatgccagttaacaagctgttataatattccagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84680 - DNA, 2148 bp, Homo sapiens
gcggaaacatggcggcgggaagggagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84681 - DNA, 1631 bp, Homo sapiens
agcttggaccccacgctgacttgtttcgcaaacacgagatcgatggcaaggccctgctgctgctgcgcagtgacatgatgatgaagtacatgggcttgaagctggggcctgcactcaagctctcctaccacattgaccggctgaagcagggcaagttctgaaccaggagagtacagccacagccacgacaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84682 - DNA, 504 bp, Homo sapiens
gcggaaacatggcggcgggaagggagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatggtaagtatctttttaccctatcgtggaggtaagagggattaagagacctagcaaggactggctttaaggaattcctcacgaataattagactactcgttatccttttctttatagccatgatgtcatttttgtcattggcatgaattttccagattgggagaggaggtctgaagttttgctttttaaatacttaaaaatatttctcggtgctcatgcctgtaattccaacactttgggaggctgagacaggagaattgcttgaacccgggaggcggaggttgctgtaagccgagatctcaccattgcactccagcc

SEQ ID NO: 84683 - DNA, 482 bp, Homo sapiens
acttgtcactcactgccatagagtacagccacagccacgacaggtacctaccaggtaggagctgggatggggcctgggctgagagtgggggacagggctagcagcagcacctgcaggggcccagggtcagccttcagaactactggcctggcacctactatctagaggtctgcttttctgtcccttacctttgccatatctgagacttctcagcctcctctcatctttactttttcttcaggattttgttttctgtctctaggatcacccctatttcttctagatccttatccctagataaaaggtggttcgcaattccccttctgagtttcagactgcatgtggagccaccaagaagtcacagaacgtctcccagtgtgaacctggcagcaaaggcctaacacacatctcccttgccagcaggaaggtttagtctcaggctacagattgagaaatttgctccctggtgattggccatctat

SEQ ID NO: 84684 - DNA, 401 bp, Homo sapiens
tgctgcttgctccactcaaacaggtatctgggagccagcactctggcagtccttctaagctctaactctggttttactgtttttcaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggtaagcttaccagagtcctggccctccttccctccctcactctttccttcacttccttcctgagctctgggaggccagagaggacctagctctgttgccctctgcctggtggtgggactagggactggacttac

SEQ ID NO: 84685 - DNA, 258 bp, Homo sapiens
cccaccacctgcctcaccaacaaccagcactcctgaaccggataccagcactgtaccccaggatgctgccaccatccccagctcagccatgcaggccccaacaggtaagagcagatgacaggactacctgcgcacaagccccagacctagtgtttgcactttcttttgtcttacaccagtaattagcacctttccacttgtaaacctaggtaaaatatttttaaaaaattttatctttggcatttgaaataatgtcag

SEQ ID NO: 84686 - DNA, 593 bp, Homo sapiens
aaattagcatacaaagaaactgacttgtcagaagtcagagcaaggtattggtggatccagggataaatcccaaacttcttaacccctagaccggtttttagtccattgactatgcagcctaatggtaagtatctttttaccctatcgtggaggtaagagggattaagagacctagcaaggactggctttaaggaattcctcacgaataattagactactcgttatccttttctttatagccatgatgtcatttttgtcattggcatgaattttccagattgggagaggaggtctgaagttttgctttttaaatacttaaaaatatttctcggtgctcatgcctgtaattccaacactctgggaagccaaggtgggcggatcacctgaagtcaggagttcgagaccaacatggagaaaccccatttctactaaaaatacaaaactggtgggcatggtggcgcatgcctgtaatcccagctacttgggaggctgagacaggagaattgcttgaacccgggaggcggaggttgctgtaagccgagatctcaccattgcactccagcctgggcaacaagagcaaaactccatctcaa

SEQ ID NO: 84687 - DNA, 3251 bp, Homo sapiens
gcggaaacatggcggcgggaagggagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84688 - DNA, 3322 bp, Homo sapiens
gcggaaacatggcggcgggaagggagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84689 - DNA, 3158 bp, Homo sapiens
gggggcatatttcagcccttttggtgttacagcaactcttttagccacgccgttcagcagatcccgagttcttgtcctgcaaccaggaagaatgaggtacgcagacaagtggagggtgagcaagatgaagaggtgctgtattgagcaatggaacagctcagagaagactcacagtgccagggcgtcccagtgagtgttcagcccctagcaggaaggatagctcctctctgcagtgatagactggagtgatgttagaaaacacaaatatggtcacctatcagagtctgcatcccaatatcaagaagctgctgacatcctggatctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84690 - DNA, 3714 bp, Homo sapiens
gcggaaacatggcggcgggaagggagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagcatctagtgctttttgcatggcccaaaggggctctgtgctgctccactacagaggaaacttcaagaaatgctggtttgctacagtgttttagcttgtgagattctctgggaccttccctgctccatcatggggtcacctctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtggaccttcgtgggaccacagcttaaacttcaaggtgtcaggaagacctccaaggctctcctcatccaaaagagatgcacctgatactgtccatcttaatatcctgtttctttcctttgttataatagttgctaatatttttagctacctgtattttgtcatctgcctcactatagtaaatgttccatgaggatagagacaatatctttttcaccattctcagtatccatcatcctaactgtcatatggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84691 - DNA, 2341 bp, Homo sapiens
cattggtccgagagaaattagccgtcttaatggatccactaccttttgtctgaactatttctccacctagagaaagcccccaaaggataaatcccaaacttcttaacccctagaccggtttttagtccattgactatgcagcctaatgttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84692 - DNA, 1474 bp, Homo sapiens
ctgcgccatgagagccaagtggaggaagaagcgaatgcgcaggctgaagcgcaaaagaagaaagatgaggcagaggtccaagtaaaccgctagcttgtggcctcccaccaagcactgcctcagctgtgcgcaggctatgctccaggggagtgttaaaaggatcaaatgaaagaagggatatggaatcattttggaaactaaatcgttccccaggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctcatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggt

SEQ ID NO: 84693 - DNA, 1386 bp, Homo sapiens
aaccctcctttaggaataagcttgcggccgcgggcagcagagccggccgctcgttctccagccgtcttcaggacagccgcagcctggacgggctgagcgaggcgtgcggtggcgccgggtcctcagggagtgccgagtccggcgcgggcggcggacgccgcgccaccatctccagtcccctggagctcgaaggcacagtgagccgccacggcgaccttacccactttgtcgccaacaacctgcaactcaagatccgtctgagcggcgcgcctccacccccgccttctgcccctgcgcggccctgcccagcgcctgcacccacacccacaccggccattccccccatcgaccccgaggtgctgcgggatctggagcggttgagtcgggagctgggaggccgggtggaccgtctgcttcgcggtctgggtggcgcggtgcaggagctgacggcgctgagcgtgggttgcatccagacctaccgcgatgctgtggactccttaggtgaagccgtggacatgagcatcaagggcatgtacaccctgctggcgcgctgcgaggagctggagcgggctctgcagccggttcaggggctggcgcgccaagtccgggatatccgacgtactctggaggtgttggaggccctgtgcaagtgaccaggaggacaggagaggccggtcctggccagggcagggcccagcaggaccctaaggactcttcagggagtcctggtgggaagtgcccactgaggggaggcctgtgtgttggaggctcttccagatgcgttcagctggcccgtgcccactcgctgggccttaggctggtgtatgtggggaagttctaacggctctcctggtgggaagggatgttgctctgcttgtattcagttggccatctgtagctaccctgttcttcccaactctcctccctagctagagcaccagccctgggaacacggggctttaggtctgcttgaaggtgaggacgtgactcccacatgtaatcaggagaaagggacagaggaagccccagcccccactgtggctatcctgactccagtggccacatctcaggtgccaggggctgtgggagcttgtgccgtccttggccaaacaccccgcaggcaaagatgcacccctgctgatggagagccttctgcttctgccctctggccctctaccataccacttccccagccagaaccggcgtgcagctaggaggaatgggttgcacggcggagggggtgaggtgggaggcgtctcactgctctcagggttcaggtagaatgttgctggttttgaagctcacctgttgtggagtgttctaatcagttttggctttctgagtttttgtggaattaaagtgctgctgctgcgaaggctgaggctg

SEQ ID NO: 84694 - DNA, 1601 bp, Homo sapiens
ccccacctggagtatggagtcgtctcgggggcggcccgggcccgagacggaccttctggctgtagcggaacatcaggccctagtctttggcggcgggccgggccgaacgtcctctgagccgcccgcaggcctccgggtgtccggggaggaagagaccgagaacgttgggggcgcgaaccgccaccccaggacgtccccgaagacgtcaagctgcggcgtcgtccaccggccggaacgggaggctctggagaacgagcccggccctcaagggacgctgtctggggccgggagccgcaggggggcgccgggtgcagagcacgaaccttccctgtcctcccggcacaagaacccggcgccgcccgagggcaagccctcctccgggagggactgccgtcgagggggaccaggcggcgggatggatgttgagcagcaggaggaggaagacaacgacgaggaggcggccgcgggcagcagagccggccgctcgttctccagccgtcttcaggacagccgcagcctggacgggctgagcgaggcgtgcggtggcgccgggtcctcagggagtgccgagtccggcgcgggcggcggacgccgcgccaccatctccagtcccctggagctcgaaggcacagtgagccgccacggcgaccttacccactttgtcgccaacaacctgcaactcaagatccgtctgagcggcgcgcctccacccccgccttctgcccctgcgcggccctgcccagcgcctgcacccacacccacaccggccattccccccatcgaccccgaggtgctgcgggatctggagcggttgagtcgggagctgggaggccgggtggaccgtctgcttcgcggtctgggtggcgcggtgcaggagctgacggcgctgagcgtgggttgcatccagacctaccgcgatgctgtggatcttcagggagtcctggtgggaagtgcccactgaggggaggcctgtgtgttggaggctcttccagatgcgttcagctggcccgtgcccactcgctgggccttaggctggtgtatgtggggaagttctaacggctctcctggtgggaagggatgttgctctgcttgtattcagttggccatctgtagctaccctgttcttcccaactctcctccctagctagagcaccagccctgggaacacggggctttaggtctgcttgaaggtgaggacgtgactcccacatgtaatcaggagaaagggacagaggaagccccagcccccactgtggctatcctgactccagtggccacatctcaggtgccaggggctgtgggagcttgtgccgtccttggccaaacaccccgcaggcaaagatgcacccctgctgatggagagccttctgcttctgccctctggccctctaccataccacttccccagccagaaccggcgtgcagctaggaggaatgggttgcacggcggagggggtgaggtgggaggcgtctcactgctctcagggttcaggtagaatgttgctggttttgaagctcacctgttgtggagtgttctaatcagttttggctttctgagtttttgtggaattaaagtgctgctgctgcgaaggctgaggctg

SEQ ID NO: 84695 - DNA, 1820 bp, Homo sapiens
ccccacctggagtatggagtcgtctcgggggcggcccgggcccgagacggaccttctggctgtagcggaacatcaggccctagtctttggcggcgggccgggccgaacgtcctctgagccgcccgcaggcctccgggtgtccggggaggaagagaccgagaacgttgggggcgcgaaccgccaccccaggacgtccccgaagacgtcaagctgcggcgtcgtccaccggccggaacgggaggctctggagaacgagcccggccctcaagggacgctgtctggggccgggagccgcaggggggcgccgggtgcagagcacgaaccttccctgtcctcccggcacaagaacccggcgccgcccgagggcaagccctcctccgggagggactgccgtcgagggggaccaggcggcgggatggatgttgagcagcaggaggaggaagacaacgacgaggaggcggccgcgggcagcagagccggccgctcgttctccagccgtcttcaggacagccgcagcctggacgggctgagcgaggcgtgcggtggcgccgggtcctcagggagtgccgagtccggcgcgggcggcggacgccgcgccaccatctccagtcccctggagctcgaaggcacagtgagccgccacggcgaccttacccactttgtcgccaacaacctgcaactcaagatccgtctgagcggcgcgcctccacccccgccttctgcccctgcgcggccctgcccagcgcctgcacccacacccacaccggccattccccccatcgaccccgaggtgctgcgggatctggagcggttgagtcgggagctgggaggccgggtggaccgtctgcttcgcggtctgggtggcgcggtgcaggagctgacggcgctgagcgtgggttgcatccagacctaccgcgatgctgtggactccttaggtgaagccgtggacatgagcatcaagggcatgtacaccctgctggcgcgctgcgaggagctggagcgggctctgcagccggttcaggggctggcgcgccaagtccgggatatccgacgtactctggaggtgttggaggccctgtgcaagtgaccaggaggacaggagaggccggtcctggccagggcagggcccagcaggaccctaaggactcttcagggagtcctggtgggaagtgcccactgaggggaggcctgtgtgttggaggctcttccagatgcgttcagctggcccgtgcccactcgctgggccttaggctggtgtatgtggggaagttctaacggctctcctggtgggaagggatgttgctctgcttgtattcagttggccatctgtagctaccctgttcttcccaactctcctccctagctagagcaccagccctgggaacacggggctttaggtctgcttgaaggtgaggacgtgactcccacatgtaatcaggagaaagggacagaggaagccccagcccccactgtggctatcctgactccagtggccacatctcaggtgccaggggctgtgggagcttgtgccgtccttggccaaacaccccgcaggcaaagatgcacccctgctgatggagagccttctgcttctgccctctggccctctaccataccacttccccagccagaaccggcgtgcagctaggaggaatgggttgcacggcggagggggtgaggtgggaggcgtctcactgctctcagggttcaggtagaatgttgctggttttgaagctcacctgttgtggagtgttctaatcagttttggctttctgagtttttgtggaattaaagtgctgctgctgcgaaggctgaggctg

SEQ ID NO: 84696 - DNA, 358 bp, Homo sapiens
aataatctttatttttgtttacagaaaactgaattttgcttataatagaagacttgtttatattactgattgataatttaatggattttgttgaaaatttaagcaaattagaatcccaaagctcttcagtattaaagtattagtatctttttttctaacaagggaaccatagaaaacataaattatattcttcttcttctgataccttttgtatgttacagtttaaaaaactgaaaccacagccaattagcaacacattatgtctaatttaccaaaaggtaagcttcttaaattcccaagagaattaatgcaccctctctccaccactctttgaatctaatagattaagaaatgacct

SEQ ID NO: 84697 - DNA, 660 bp, Homo sapiens
ctagtatactaactactgttatgcttaactctctcattatatatacaaccttatgactttaggggcatttcattctgttcttaggcagctaagaattccccactataaggttttaggactgacttttataaaatacttttggtaatagttacctcttgggatgatctgtaatcttaaaataccacctaaggtatttctggttcattgaatatgattaagcaataactaaagtatgtaaataaatcacttttagcatgtatgtaataataaacatcttcattctaataatagcacctattttctgggattagcatttatactatttgaaatgtctaaagtaggtagatataaccagagattatttgaagaaaatgaatatgtgtaatcactgaaaatcacatttctctgaatccttgcctacctgacagttttttaggagaacagaactgttgctcaaagacttgtctagagagaatgactgactctccagatcagttactcgtataatctgaatatcaccatcttcatgcccactcttcataagctgcttttgagaaagagacagatagctgtatacagtgcatcaaagcaataaatcctagtgtcaagacttttactcaatcacatatcactatagacatgtagagactaaatcatata

SEQ ID NO: 84698 - DNA, 182 bp, Homo sapiens
tgctgggattataggcatgagccagtgtgcctggcctgaagtgttcttctctgtttgctgaaagtatgttcatattgtgttttggtgagttgttaactgggatacagagacgtgtaggacaggccaacctcactggtggaaaggcattgaagactagaatgaaaccagccccatgaagaacg

SEQ ID NO: 84699 - DNA, 516 bp, Homo sapiens
gcctggcgagccgccttacctagctggccaggaattccaggagtcaggcttcctgatctaaatctgtcctggtcccgtcttggctgggtgccaccagcagcaacggcacactccagcttaaatatcagtggggataattctaggccgtttgtctgcctggttcttccaggatagaggcagtgatttcagtaatctcttagggctgggcacggtggctcgcgcctataatcccagcactttgggaggccgaggcgggtggatcacctgaggtcaggagatggagaccatcctggctaacatggtgaaaccccgtctctactaataatacaaaaacaaaattagccgggcgtgggggcaggcgcctgtaatcccagctactctggaggctgagacaggataatggtgtgaatccgggaggcggagcttgcagtgagccgagattacaccactaccctccagcctgggcgacagactccagcctgagcgacagagtgagactccgtctcaaaaaaaaag

SEQ ID NO: 84700 - DNA, 509 bp, Homo sapiens
gcctggcgagccgccttacctagctggccaggaattccaggagtcaggcttcctgatctaaatctgtcctggtcccgtcttggctgggtgccaccagcagcaacggcacactccagcttaaatatcagtggggataattctaggccgtttgtctgcctggttcttccaggatagaggcagtgatttcagtaatctcttagggctgggcacggtggctcgcgcctataatcccagcactttgggaggccgaggcgggtggatcacctgaggtcaggagatggagaccatcctggctaacatggtgaaaccccgtctctactaataatacatataccgggattgaaagcagacgtccatagatctctccctcacaagcgttcccagactgcctccagctgttgctctcccctcccagtctcaactcactgggatgaggttaggtcatgagacaccaaaaccttaaaattaaacaaaaggccaaacaagccttagcttttcttaaagactga

SEQ ID NO: 84701 - DNA, 438 bp, Homo sapiens
tttgaagcagggtcttgctgtgtcactcaggctggagtgcagtggtgcgatcagagctcactgcagcctcgaactcccaggctcaagtcatcctcctacctcagcttccttagtacctgggattacaggcacatgtcaccatgcccatctaatttttaaataaattttttctggagatggggtgctcgctatgttgcccaggctgatctcaaactctaggcctcaagtcctcctgccccgacctcccaaagtgctgagattacaggcatgagccactgtgctcagccccaacaattatttttgacagataatagggatgtctccttgctctctgtgtctggccaagtagccccaggtgacactcgttttttttgtttgtttgtttttgagacggagtcatgctctgttgcccagcctggagtccaatgccgtcgtctc

SEQ ID NO: 84702 - DNA, 478 bp, Homo sapiens
cccgagacctgcacactgtaatccttccccaatcctccctggctcagatacctctccagattccttccccatccaggggtccctgggtgggtgggtcagcagccaggctctatcgattgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggccccctacccacctctgccatgcctaggaatcccacccctgtgtgaatgggactccctttcctccatgtgacacccacaggggtccatgacccatctaggagactttatagcagttgggtgggaggggaatgctcttaatttatcaataaaatattttcagaggag

SEQ ID NO: 84703 - DNA, 317 bp, Homo sapiens
ttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtacaaaattgtaaaactggttgtacaatcatgatgttagtaatggtaatttttttaaattaatttacccttaagagtatgttagatttgattacctgataatgattatttaaatattcctatctgcttataaaatggctgctataataataataatgcagatgatgttatat

SEQ ID NO: 84704 - DNA, 147 bp, Homo sapiens
tccacctcccaaagtgctgggattacaggcatgagccactgcgcccggccgtccctttgttacttaacaaatgggagcacactgctttttaagcacactgcactttgtttttgtttttttgtttttttgtttttttttttgagacgg

SEQ ID NO: 84705 - DNA, 464 bp, Homo sapiens
ctttatataaaatggaatcatgcagtgctgtgatagaatcataaccactaaagatatccacatcctaacccccagaatctctgaatatgttaccttgcccaacataagggactttgcagatgtgatttagttaaagacattgagacagggagattatgctgtattattcagtgtgcccagtttaagcagaagagtcctttataagagggaggtggaaaaggtaagagtgatgggatgtgaaaaagactccaccttctgttgctgactttgaagattgacaaagaggccatgagccaaggactatggggtggcctctagaaggtgcaaaagacaaggaaacagatactcccctggaacctccagaaggaacacagcttctaccaatgctttgactttagccagtgatccttgtcagacttctacagaattataaaataataaatttgtgttgtttcaagcccatt

SEQ ID NO: 84706 - DNA, 459 bp, Homo sapiens
tgtgcagtgatcaccacaatctaattttagaatattttcatcaccctgtgtctatttacagccactccacatcccgtgcccgcaggcaaacacttatctatttagtttctatagattgattttattactctttttaatagcaacctgtggtccattttggaaaaatacaaacatgtatttaattgtgctttatccaagcacatttagcttttgctgatgttttattttgctgcctgcctactttaaaaaaaattggaaaagattgaaattttgtctttgagccatacttgttaagagtgataagggagttttagctgaagttgtttgtagattttccagtcattacctgtggaactaggagaagaattttggggcctggataattatttatatttgaatagaaactgcctgaggttgttcttgattagatgaaagccccagcatttattgtgtatttta

SEQ ID NO: 84707 - DNA, 1291 bp, Homo sapiens
aagagaaaactcctccaaaagcagctctcactatcagaaaacccaactacagttgtgaacgccttcattttctgcctgaggtctcagtccgtcggcccagactgaagtgcagtggcacaatcatagctcgctgcagcctcgaccttccaggcttaaacgattctcccacctcagcctctcgagttgctgggaccacaggtcactgtgcatggcatcatcctggccccctctagagctccaatcctccaaccagagccagctcttccctcaaaatgctacggcctgtgacaatgctccagaagcctgggacctgctgcacagagtgctgccgacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaaggtgcgggggccgcaaggatagcaagaccacagcgctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaaaacagcattgaaccaagaagc

SEQ ID NO: 84708 - DNA, 214 bp, Homo sapiens
cttgagccgaagagttcaagaccagcctgggtaacatagtgagacactgtctctacatacaaaaattagcttagcatggtgacacgcagcggtagtcccagcttctctggaggctgaggtggcagagttgcttaagcctaggaggttgaggctgcagtgaactgtgatcataccacagtaaccagcctgggtgacagagcaagaccctgtctca

SEQ ID NO: 84709 - DNA, 433 bp, Homo sapiens
aggtggcctcagtcttcccacatggaaatgctttggattcatctggaagttagagtcttctgaagaccactgtctccttccagccctcggtgggagtgctgggtcttaggtggacacttgtaccctcggtggggtctttgcacccttcccttgggacacacgtagatatttattttaacatctgctgaaaaaggaagtggtatctgagtccagaacagaaaaccaagcacacctgcccctggatgggaaaggcagggtcagggcccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctcta

SEQ ID NO: 84710 - DNA, 3523 bp, Homo sapiens
cccgcctccctaggcgtggaggagggggggcggctcagccccgcgcccgtgcgcgcgctcgcggccgggttgcagggctgggcgcgcgccccgcgtcccgggcaggaagatggtggcgagcgcgcgagtgcagaagctggtgcggcgctacaagctggcgattgccacggcgctggccatcctgctgctgcagggcctgaaaggaaggcagaggaagccacggccactggaccctggcgaaggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacctccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgacgatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtacggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggaggttggcactgattgggaccccaaagagcgtcttttccggaactttggggggttactggggccgctggacgagcctgtggccgtgcagcgctgggcccggggccccaacctcacagccacagtggtctggatcgacccaacctatgtggtggccacatcttatgacatcacagtagatacggagactgaggtcacgcaatacaagcccccactgagccggcccctgcggccagggccctggactgttcgactccttcagttctgggaaccgctgggtgagacccgcttccttgtgctgcccttgaccttcaaccgcaaactacctctcaggaaagatgatgccagctggctgcacgcagggccaccccacaacgagtacatggagcagagtttccagggcctgagtagcatcctgaacctgcctcagccggagctcgcggaggaggctgcccagcggcacacacagctcacaggccctgcgctcgaggcctggacagacagggaactgagcagcttctggtccgtggctggactgtgtgccataggcccctctccctgcccctccctggagccctgcagactgaccagctggagctctctgtcccccgaccccaaatcagagctggggcctgtcaaagcagacgggcgactcaggtagcagggccccagccagtacccgtggaggacccgggaaattgcaccttacagacagtggaggggtgtcccctcccacaggcaagaaccagaggcccaggctgcacacccatttcagccatcaagaacccacacagacggcagggaaggtggacacagtatgaactactgctgatgtctctgttggggatcagagggctggcgggaacgcgagaagggcaccagcagcattccacacccagctcttcctcaccttcctgtctagtttgaatttcttttttttctttcttttttttttttttttaatttaaaaaggaaaatgggtggttgggagagaaactagaacagaagatgtgcaatagggctcagagcagccccaggaagtgggccatgtctgtggggagcagtggcttgctgagcccacctgctattgttctgcacgaggctgggcctgcctcactctccagggcctcatgccccattctgggcctgtggtgctcgtggctgaggctccacagggctgcaagtgccctgccaggctctaaggcccgaagaacaggtgatatcgggggcgctgcagagctgggctctagcaggacagttcttttgtagccaggggaccctagaagtggggtggggcggctccagggctttccagcataccctgcccctggatgggaaaggcagggtcagggcccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctcta

SEQ ID NO: 84711 - DNA, 3724 bp, Homo sapiens
cccgcctccctaggcgtggaggagggggggcggctcagccccgcgcccgtgcgcgcgctcgcggccgggttgcagggctgggcgcgcgccccgcgtcccgggcaggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgaaggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacctccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgacgatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtacggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggaggttggcactgattgggaccccaaagagcgtcttttccggaactttggggggttactggggccgctggacgagcctgtggccgtgcagcgctgggcccggggccccaacctcacagccacagtggtctggatcgacccaacctatgtggtggccacatcttatgacatcacagtagatacggagactgaggtcacgcaatacaagcccccactgagccggcccctgcggccagggccctggactgttcgactccttcagttctgggaaccgctgggtgagacccgcttccttgtgctgcccttgaccttcaaccgcaaactacctctcaggaaagatgatgccagctggctgcacgcagggccaccccacaacgagtacatggagcagagtttccagggcctgagtagcatcctgaacctgcctcagccggagctcgcggaggaggctgcccagcggcacacacagctcacaggccctgcgctcgaggcctggacagacagggaactgagcagcttctggtccgtggctggactgtgtgccataggcccctctccctgcccctccctggagccctgcagactgaccagctggagctctctgtcccccgaccccaaatcagagctggggcctgtcaaagcagacgggcgactcaggtagcagggccccagccagtacccgtggaggacccgggaaattgcaccttacagacagtggaggggtgtcccctcccacaggcaagaaccagaggcccaggctgcacacccatttcagccatcaagaacccacacagacggcagggaaggtggacacagtatgaactactgctgatgtctctgttggggatcagagggctggcgggaacgcgagaagggcaccagcagcattccacacccagctcttcctcaccttcctgtctagtttgaatttcttttttttctttcttttttttttttttttaatttaaaaaggaaaatgggtggttgggagagaaactagaacagaagatgtgcaatagggctcagagcagccccaggaagtgggccatgtctgtggggagcagtggcttgctgagcccacctgctattgttctgcacgaggctgggcctgcctcactctccagggcctcatgccccattctgggcctgtggtgctcgtggctgaggctccacagggctgcaagtgccctgccaggctctaaggcccgaagaacaggtgatatcgggggcgctgcagagctgggctctagcaggacagttcttttgtagccaggggaccctagaagtggggtggggcggctccagggctttccagcataccctgcccctggatgggaaaggcagggtcagggcccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctctactctgggctctgtgtttttcctcctgggtgtcaggaagccatcaccattcattgggccttctccagaagtcttagctggtactttggtagccttgagaaggtaaagatctcattcctccagattaagaacagtttagaatccacccagagggactc

SEQ ID NO: 84712 - DNA, 2622 bp, Homo sapiens
cccgcctccctaggcgtggaggagggggggcggctcagccccgcgcccgtgcgcgcgctcgcggccgggttgcagggctgggcgcgcgccccgcgtcccgggcaggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgaaggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacctccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgacgatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtacggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggaggttggcactgattgggaccccaaagagcgtcttttccggaactttggggggttactggggccgctggacgagcctgtggccgtgcagcgctgggcccggggccccaacctcacagccacagtggtctggatcgacccaacctatgtggtggccacatcttatgacatcacagtagatacggagactgaggtcacgcaatacaagcccccactgagccggcccctgcggccagggccctggactgttcgactccttcagttctgggaaccgctgggtgagacccgcttccttgtgctgcccttgaccttcaaccgcaaactacctctcaggaaaggtaagcgtgcagttctcaaatgaggcccagaagccagacagaataggactcgccagagaggtgacctcaagaagccaaccatcagagctgactcccatccctagagtcagggaagcatggaagggctggggccttcatcttctttcctgtagcatgcagggtcctgcactgcagtgtggtggaaaagggagctttacagtcatgcacacttggtttggaacataactctcacaagttc

SEQ ID NO: 84713 - DNA, 1760 bp, Homo sapiens
cccgcctccctaggcgtggaggagggggggcggctcagccccgcgcccgtgcgcgcgctcgcggccgggttgcagggctgggcgcgcgccccgcgtcccgggcaggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgaaggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacctccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgacgatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctcta

SEQ ID NO: 84714 - DNA, 567 bp, Homo sapiens
cagagacgcttgagatgtggctgatgccccaagggtcgctgaagctgttggggcgcagtgaccaggccagccggctccagagtctggaggtgggacaggtcccccacttgctttctcccaacccccacccagacttggggtagtgggaagagagggacagacaccaagggaggggtaaggttatttttcccagtcatggcagccatggtgatgcccccatgcagacatcctgtgtcaccccccagcctgtgcacactgaggagcacctcctggttggggtatgcagaggacatgcagggagcagggagggaattatcagttccactacaacacaagcccaatcttccagactacagagatttcgcctagaggggcagggacattcgagttgggccatgaaactacacttctgagtggctcctcatagtctttttttttttttttttgagacagtctcactctgtcgcagtggcacaatctcggctcactgcaacctctgcctcccaggttcaagcgattctcctacctcagcctcccgcgtagctgggactacaggcgcgcgccacc

SEQ ID NO: 84715 - DNA, 3568 bp, Homo sapiens
cccgcctccctaggcgtggaggagggggggcggctcagccccgcgcccgtgcgcgcgctcgcggccgggttgcagggctgggcgcgcgccccgcgtcccgggcaggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgaaggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacctccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgacgatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtacggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggaggttggcactgattgggaccccaaagagcgtcttttccggaactttggggggttactggggccgctggacgagcctgtggccgtgcagcgctgggcccggggccccaacctcacagccacagtggtctggatcgacccaacctatgtggtggccacatcttatgacatcacagtagatacggagactgaggtcacgcaatacaagcccccactgagccggcccctgcggccagggccctggactgttcgactccttcagttctgggaaccgctgggtgagacccgcttccttgtgctgcccttgaccttcaaccgcaaactacctctcaggaaagatgatgccagctggctgcacgcagggccaccccacaacgagtacatggagcagagtttccagggcctgagtagcatcctgaacctgcctcagccggagctcgcggaggaggctgcccagcggcacacacagctcacaggccctgcgctcgaggcctggacagacagggaactgagcagcttctggtccgtggctggactgtgtgccataggcccctctccctgcccctccctggagccctgcagactgaccagctggagctctctgtcccccgaccccaaatcagagctggggcctgtcaaagcagacgggcgactcaggtagcagggccccagccagtacccgtggaggacccgggaaattgcaccttacagacagtggaggggtgtcccctcccacaggcaagaaccagaggcccaggctgcacacccatttcagccatcaagaacccacacagacggcagggaaggtggacacagtatgaactactgctgatgtctctgttggggatcagagggctggcgggaacgcgagaagggcaccagcagcattccacacccagctcttcctcaccttcctgtctagtttgaatttcttttttttctttcttttttttttttttttaatttaaaaaggaaaatgggtggttgggagagaaactagaacagaagatgtgcaatagggctcagagcagccccaggaagtgggccatgtctgtggggagcagtggcttgctgagcccacctgctattgttctgcacgaggctgggcctgcctcactctccagggcctcatgccccattctgggcctgtggtgctcgtggctgaggctccacagggctgcaagtgccctgccaggctctaaggcccgaagaacaggtgatatcgggggcgctgcagagctgggctctagcaggacagttcttttgtagccaggggaccctagaagtggggtggggcggctccagggctttccagcataccctgcccctggatgggaaaggcagggtcagggcccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctcta

SEQ ID NO: 84716 - DNA, 1431 bp, Homo sapiens
aaagtgccttgaacccactgctttactgcatcctaaagttgggaatctaaggcttactgccttgattttataaaactcagttttataggcacagaaagtcccttggattagcccaaggtcattcagcaagctgtgactcagaagtagggctgtgacaggaactggggtacccagacccaactcctgggtctggcctccacggagtctgttgcagggggtgtgcttactgcctgctctgcacccacagatgatgccagctggctgcacgcagggccaccccacaacgagtacatggagcagagtttccagggcctgagtagcatcctgaacctgcctcagccggagctcgcggaggaggctgcccagcggcacacacagctcacaggccctgcgctcgaggcctggacagacagggaactgagcagcttctggtccgtggctggactgtgtgccataggcccctctccctgcccctccctggagccctgcagactgaccagctggagctctctgtcccccgaccccaaatcagagctggggcctgtcaaagcagacgggcgactcaggtagcagggccccagccagtacccgtggaggacccgggaaattgcaccttacagacagtggaggggtgtcccctcccacaggcaagaaccagaggcccaggctgcacacccatttcagccatcaagaacccacacagacggcagggaaggtggacacagtatgaactactgctgatgtctctgttggggatcagagggctggcgggaacgcgagaagggcaccagcagcattccacacccagctcttcctcaccttcctgtctagtttgaatttcttttttttctttcttttttttttttttttaatttaaaaaggaaaatgggtggttgggagagaaactagaacagaagatgtgcaatagggctcagagcagccccaggaagtgggccatgtctgtggggagcagtggcttgctgagcccacctgctattgttctgcacgaggctgggcctgcctcactctccagggcctcatgccccattctgggcctgtggtgctcgtggctgaggctccacagggctgcaagtgccctgccaggctctaaggcccgaagaacaggtgatatcgggggcgctgcagagctgggctctagcaggacagttcttttgtagccaggggaccctagaagtggggtggggcggctccagggctttccagcataccctgcccctggatgggaaaggcagggtcagggcccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctcta

SEQ ID NO: 84717 - DNA, 2874 bp, Homo sapiens
cccgcctccctaggcgtggaggagggggggcggctcagccccgcgcccgtgcgcgcgctcgcggccgggttgcagggctgggcgcgcgccccgcgtcccgggcaggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgaaggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacctccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgacgatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtacggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggaggttggcactgattgggaccccaaagagcgtcttttccggaactttggggggttactggggccgctggacgagcctgtggccgtgcagcgctgggcccggggccccaacctcacagccacagtggtctggatcgacccaacctatgtggtggccacatcttatgacatcacagtagatacggagactgaggtcacgcaatacaagcccccactgagccggcccctgcggccagggccctggactgttcgactccttcagttctgggaaccgctgggtgagacccgcttccttgtgctgcccttgaccttcaaccgcaaactacctctcaggaaagatgatgccagctggctgcacgcagggccaccccacaacgagtacatggaagctgggctctagcaggacagttcttttgtagccaggggaccctagaagtggggtggggcggctccagggctttccagcataccctgcccctggatgggaaaggcagggtcagggcccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctctactctgggctctgtgtttttcctcctgggtgtcaggaagccatcaccattcattgggccttctccagaagtcttagctggtactttggtagccttgagaaggtaaagatctcattcctccagattaagaacagtttagaatccacccagagggactc

SEQ ID NO: 84718 - DNA, 464 bp, Homo sapiens
aaatacaataaggctattaaaaaccacgctagcattgaatataaggaaatgtttgtcatttagcaagtaaaaaaatcaggttataaaacatgataaataataccttttcttgactaataaatacatacacacacacacatactagaaaagcataccagatattaagtagttatctttgcatcctaggaataactgtttaattatattttttctttgtgtttttctgtattttatttttaaaagtaaacatacattactcttttgatcagaaaaaagtattgcattttttaaaaggaatattttataatggtctaaaaattcttgctcatagttttaaagtaggaataagttttaaattggattcttcccatccaactcttcacggttagcagctacgatattattctcctttgtagggaagtattaatacatcattctggattcccaggatgaccttaactgat

SEQ ID NO: 84719 - DNA, 309 bp, Homo sapiens
acttagccacctgggctccatcttgaaggactggcttagccacccaggatccatctcgaaggacgtttttaggttcacatttgttcacagtatagagatggcaaggaacttgctgaagctcccagctaggaagtaggagagtatagcttttgaatccatgcactttggctccagcacttgcgtactgaagtacaagatggatgataagaggcaagggtccatttgtgagctggagtcacaaattcaagttcaagaacaagagcataactgctcagcatgagacaaggagaggaactctgttattgaaat

SEQ ID NO: 84720 - DNA, 299 bp, Homo sapiens
ttgctgagagagatgatgtttcatgggtgatgtctctggaagagattggataggacccaagcacagagcaagaaattggctttaggcaagtcagatttgtcttatactagttaggagtaaagagaaatggatgatacagatgcagctatgttcgtaggagggaagtggagggaatttctgtgtgatggctttagtaatgtaggcagcaaggtcaactactgacagtgagaggagaaattcggggaggctggtcacagtttgaagtaataggtcatgggaggcagatgtttgtgggtgga

SEQ ID NO: 84721 - DNA, 604 bp, Homo sapiens
ttaatgtataatttctctttatcaacgttgattagtaaaaattattcagtgctccagaagtgaacagttttaccccatggtgtattctttttatgtattaaagatagaactatgatgaattacagttttacttttcaaaagcttaaaattataattagcagtaatacatgaattatatttgttactgtgagttgtcagtagttggtttattaatcatggagccaacttagttcttattatgtggcgtgtaaagatttagggcagatctgcccagtagaacttcctatgttgatggaactcctctatacctttgctgttccatatagaagcaactaggcacgtgtggcgcctgaaatgtgactggtgaaactgaggaactacatttttatttttatttaattgtaattaaatttaaatagccgtaagtgactaagggcactgtattataaagcacagatttgaatcaactcatagcaactctttgcctccttggtgccctttagagcctggccagtaatggagagaattacccctgctggcattttctgtcagaaaagtgtggttctgcataaattatcatttgaataatgcttataggtttcac

SEQ ID NO: 84722 - DNA, 387 bp, Homo sapiens
tgcacacatgaaactaatttagaaccatctagaacagtttataatcagtgaaatatttatataatgaagtgcaaaaattttggaagcagatataacatgctctgggtagtcagaaaagggagctattgataatgtccagagtcaattagaaggcttcactcaaggctgcagtgccgtggcgtgatctcagctcactgcaacctctgcctcctgggttcaagcaattctcctgcctcagcctccggaggagctgagattacaggtgggtgccaccaaaactggctaatttttgtatttttagtagagacagggtttcaccatgttggccaggctggtctcaaactcctgaccttggcctcccaaagtgctgggattacaggcatgagc

SEQ ID NO: 84723 - DNA, 546 bp, Homo sapiens
gcaagagacacagaagcagcttcccctccatgaccccccaggtcaggcagtgtcctctctatgaaacaggaggaagaacacccctcacagagccgtggtgaggctcaggggctgagtgggcattaactctgcccccgtgcctagagttcagactgtgggctcccttgctctgaagctttctacatgactgcaaattgaccccagactgtgaggctcccttctgtccccttagatctggttagaacccccatcaagaggcataatctccttacttttcagatgcagaaaatgaaacccaaggaagggtaactggaacctagggccccagcctgatgcagtctctagggctcctgatacctcttgaatctaaagaaggaaagagctggctaccatcagggaggatactggggaccaaagagaaaacactgaggggctcttgtacatgtctggggtgacagagcccagaacagagcctctccacccatacccattatttctgcagcagaggcaggtttaggctggagaagttccagagcaaggcagtca

SEQ ID NO: 84724 - DNA, 754 bp, Homo sapiens
tgcttgagcccaggaggttgaggctgcactgtgtcgtgttcatgccactgaactccagcctgggtgacaaagtaagaccctgtctcaaaaaatggaaaaggaaaaggaaaaggaaagaaaaaaagtgatagctggctaagaatttcttaaacataaatagagatcaagtcaaagatccaagaagctcagcgaaacctaaacaaaataaataccaaaaaagcaaaacaaaacaacaaaacccaccacactcaggcacatcattttcaaactgctgaaaaccaaagcaaatattggtggcagacagagaaaaatgacatatagtatgcaaaggaacagaggcaagttcagccaatgtctcattagaaaccatgcaagccacactcgagtaacctctttaagggctggggggtggggaactgccaacccagaattctatgtccctggaagtaagtatctttgaaaaattaagacaaaacaactttttcaaacaaacaaaagctgagagaattcattatcagcagccttgtgctaccaaaaaaagagttattggaaagtctttagatacaatataataataccacaaagacagaaatttggatacaaaggaataaagatctctggatatgtttaagatgaaggttaaactattcttatgtttaatcaaactaaaaaaaaatacttaaagcaaaaataatagccaatatactgtagagttttagcatatataaaattaaaacgcagaaacaagatacaa

SEQ ID NO: 84725 - DNA, 453 bp, Homo sapiens
tgaatttgggggacacacaaacattcagtctataacaacaaagatgacacggtagagcagtggagaaaggatggtcttttcaataaatatgtttatggaaaaaatgtatgttgattctctacttcacatcattcataacaaattgtagatggattgttgatctaaatgtgataggtaaaacaatagagcttcctagagaatgccctaggggaatttatgatcttgaatacaccaatatttcttaaactacatacataaagtactaaccataatggaaaaagttaattacatataatacaattaagaatgtttgctgattttaaaaaatctttcaggttgcttggtggatacaatatgtgttgttccagtgatggatacactgaaggccttgaattcgccatagtgcaatatatcaatatagttaaattatactcatatcccatgaatttatac

SEQ ID NO: 84726 - DNA, 411 bp, Homo sapiens
gggtgtctatcctggctctctgggaagtgtctgtatgtgccccggctctcccatcagaccctaagttccctgtgacccaggaaagagtcttgctcctaccagaaaccgttctctgtgaaacagagaggccagatgcagtgactcatgcctgtaatcccaacattttgggaagccaaggtgggcagatcactggaggtcaggagttcgagaccagcctggccaacatagtgaaagcccatctctactaaaaatacaaacattacccgggtgtggtggcgggcacctgtaaactcagctactggagcggctgaggcaggagaatcattttgaacccaggaggcagaggctgcattgagctgagatcgaaccactacactccaacctgggtgacagagcgagactccgtctcac

SEQ ID NO: 84727 - DNA, 451 bp, Homo sapiens
ggtatgtaagtcgcaaaatttccactggataaaaagatgtctgactaaaaatactaacaacaaaaacaacaacaacaaaacaccataaacttatctaaatgagccctctcaggaatttgcgcttcttgacatgacggagtagcctacaagagacccacttgcctgctgagaaccactagaaatacacaataaaagcaatttgcttgaaagcaaaggagagctgccaaagatgtcaaaacttaaactacatcaaaaagagaggctcattgaggggagcctaaccttccgcctgtcactccagtcaccctcgccgggatttgctaattcttagtgttgaaggagaatctgagaagtcagaaagaaggtcgctgctgagaggaagagaattccttggagttttcagcaatctcatagggctgaggaggcagaaaatggagctgagcacagcccc

SEQ ID NO: 84728 - DNA, 438 bp, Homo sapiens
tcctgagtagctgggattacagacacatgccaccacacctggctaatttttgtatttttagtagccaacatggttaaagtggatttcagaagcaggaaaaaatagggagcttattgtctggctgatcgttacagaagtacccagttctgtcattccactcttgctactcagacctttaactacccatgtttatttcaccaagctaaagaagtatactacaggttgatgatccccactccgaaaatctgaaatgcttcaaaatctaaaactttttgagcactgacatggcactcaaaggaaatgctcattggagcattttgtatttcggattagggatgctcaatgagtacgtatataaggttgttccaaaagtatttcagatttccaaatgctgaaaaaatcccaaatccaaaacacctctggtcccaagcatttcag

SEQ ID NO: 84729 - DNA, 414 bp, Homo sapiens
tcacgctgggagctgtagactggagctcttcctatttggccatcttggaacctttttcccagacattctttttaaaatgatagaaagaagtaaaccagtaactatgcatatgagatgaatactggataatgataagagctttacagaaaattaaaattgggtcatttaaaaatattgatgcctgattttatgttactctatatcaggcgcagttttaagtgctcatttaatcttttgaactgctacatgtactatattaaggcaatctcccatttacagatgaggaagtaggggcacagagaaggatgccacctttctaaaatcacatagctattaagtagaaaaggcagaattcaatctcaagcaattttcttccaaggccaatgtttattattaaagtaacataggcttttc

SEQ ID NO: 84730 - DNA, 253 bp, Homo sapiens
tgagatcacaccattgcactccggcctgggtgccagactgagactctgtctcaaaaaaagaaaaaaaaaagaaaccaaaaatgttttagattatgtgccaagatgtttttaataacagctttgaggtataatccacataccatacaatgtacttaaattgtatattataattcagtgatttttagaatattcagagttgtgcaatcatcactgcaatcaattttagaacatttttatcacccctttaaaatcc

SEQ ID NO: 84731 - DNA, 384 bp, Homo sapiens
caggagaatatcggtattttcagaactgccaaatctaagactttgggttcatttttgacctgaccagaatgtattttctggattcagacaggtagtagacaccctcaaacagccataaattctaaaatctttgccattgtcatgagataataaaaaagaggcaggaggagtcaacaggtgtcagtggatcttgtttctggctcccatgtctttgacagtaagactggtgacccagcagtggttatatgcactgactcaggagacagagggcctgggttctaatcctggctctgcctcttaatgacagtgtgactatacactattttggtctcatgtgcctacttgtaaactaaggatgatatattcttaggctcatggagctgt

SEQ ID NO: 84732 - DNA, 2820 bp, Homo sapiens
  misc_feature (214)..(214): n is a, c, g, or t
  misc_feature (222)..(222): n is a, c, g, or t
  misc_feature (234)..(234): n is a, c, g, or t
  misc_feature (241)..(241): n is a, c, g, or t
  misc_feature (245)..(246): n is a, c, g, or t
  misc_feature (254)..(254): n is a, c, g, or t
  misc_feature (262)..(262): n is a, c, g, or t
  misc_feature (274)..(274): n is a, c, g, or t
  misc_feature (281)..(281): n is a, c, g, or t
  misc_feature (284)..(284): n is a, c, g, or t
  misc_feature (289)..(289): n is a, c, g, or t
  misc_feature (303)..(303): n is a, c, g, or t
  misc_feature (315)..(315): n is a, c, g, or t
aggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggtactcttnttgcccangctggagtgcantggcttnatcnnggctcacngcaacctntgcctcctgggntcaagcnatnctccngcctcagcctcccnagtagctgggantacagtctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggttgactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggt

SEQ ID NO: 84733 - DNA, 2201 bp, Homo sapiens
aggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggttgactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggt

SEQ ID NO: 84734 - DNA, 2707 bp, Homo sapiens
aggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggttgactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggt

SEQ ID NO: 84735 - DNA, 2921 bp, Homo sapiens
  misc_feature (214)..(214): n is a, c, g, or t
  misc_feature (222)..(222): n is a, c, g, or t
  misc_feature (234)..(234): n is a, c, g, or t
  misc_feature (241)..(241): n is a, c, g, or t
  misc_feature (245)..(246): n is a, c, g, or t
  misc_feature (254)..(254): n is a, c, g, or t
  misc_feature (262)..(262): n is a, c, g, or t
  misc_feature (274)..(274): n is a, c, g, or t
  misc_feature (281)..(281): n is a, c, g, or t
  misc_feature (284)..(284): n is a, c, g, or t
  misc_feature (289)..(289): n is a, c, g, or t
  misc_feature (303)..(303): n is a, c, g, or t
  misc_feature (315)..(315): n is a, c, g, or t
aggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggtactcttnttgcccangctggagtgcantggcttnatcnnggctcacngcaacctntgcctcctgggntcaagcnatnctccngcctcagcctcccnagtagctgggantacagagactgggtttcaccatgttgcccaggctggtctggaactccgtgggcttaagagatccgatccttctgcctcggccttgcaaagtactgagattacaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggttgactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggt

SEQ ID NO: 84736 - DNA, 941 bp, Homo sapiens
  misc_feature (427)..(427): n is a, c, g, or t
agcgtgggaggaggccaactctcggggcgctccctagccctgggtgggtggagcgggggaagcggagtacgttggacccggctccgccctaccccacggggccgcctggagaggtgctgggagctgggtggagcttagaggaattaaactttggccctgcgcctcgtccagcctaggttccacccttttctgggaacgtgagtatcaaccaagatcttcacttcaggtcagctccaaggaggctatccttgcccatcttcctaaaatagagctctcaaaacctggctgttttccttcagagcactggcctccaattgctccggtagattgcaaatgacctgctttctttctgttcccgggcgtttggacccctgtcttggaccgctgtcggatagtaaatcccaagtaaggtacctgccgtcggcantttgagctttcttcttggacacctaatacccagagtcctccaggctccggtagattgcaaatgacctgctttctttctgttcccgggcggcatccggacccgtcgggagaagtaaatcccaacgtaaggtacctgccgtaggcagatttcgacgctttcttcttggacacctaatacccacagtcctccaggctccggtagattgcaaatgacctgcttttctttctgttcccgggtggcatcgacccgtcggagagtacatcccaagtaaggtacctgccgttggccagattcgaagctgcattcttggacacctaatagcccgaaagtcctccaggtaagatcccaaaggcaaaggtacctagcggttgaggcgcagttggcagctgttcgtccttggacacactaaggaaccgacgagtcttccagggtaaattcccaagcgagggcacgtgcgcggcagcaaatttgcagcctagcttcattgaacacttattacccgaaggcctctcag

SEQ ID NO: 84737 - DNA, 411 bp, Homo sapiens
agcgtgggaggaggccaactctcggggcgctccctagccctgggtgggtggagcgggggaagcggagtacgttggacccggctccgccctaccccacggggccgcctggagaggtgctgggagctgggtggagcttagaggaattaaactttggccctgcgcctcgtccagcctaggttccacccttttctgggaacgtgagtatcaaccaaggctggagtgcagtggcaccatctcggctcactgcaacctctggctcccaggttcaagcgattctcctgcctcagccccctgagtagctgggattacaggcacgcgccaccactcccagtttacaccccgccactcctgagcaccgcacaccggcttcctcccagtccctcatctgagaactcatgaagccacttggaa

SEQ ID NO: 84738 - DNA, 410 bp, Homo sapiens
cttagggtaactatcccgttgtgtgaagtatgtgggggaaatacttttgttcttggggcccaatctgttccaggtggccatgaacctgcttgtgagcctgtggtgaggaagatgagaacgagaaggggacagctcttgggactggacattagtgctttcaggtcgatctgtgatgcttaccccggtttttgttctgttttcgtttttgggacagggtcttactctgtgacccacgctggagtgcaatggcaccatcacgacttactgaagcctccacttcccgggctcaagtgattctcacacctcagcctcctgagtagctgagaccacaggtgtgcaccaccacaccccactaaattttctgttttttttgtcgataatagagaaccacgggatcgctctagatacac

SEQ ID NO: 84739 - DNA, 295 bp, Homo sapiens
ctcacgcctgtaatcccagcactttgggaggccgaggcaggtggatcacttgaggtcagtagtttgagaccagcctggccaacatggtgaaacctcgtctctactaaaaatacaaaaattagccgagcctgttggcggttgcctgtagttcaagcgattctcctgcctcagccccctgagtagctgggattacaggcacgcgccaccactcccaggtatgttttagatttatgtatgtatgaatgtactagatcccacatatatttcttcctgtggttataagtcaagtgttttg

SEQ ID NO: 84740 - DNA, 985 bp, Homo sapiens
agcgtgggaggaggccaactctcggggcgctccctagccctgggtgggtggagcgggggaagcggagtacgttggacccggctccgccctaccccacggggccgcctggagaggtgctgggagctgggtggagcttagaggaattaaactttggccctgcgcctcgtccagcctaggttccacccttttctgggaacgtgagtatcaaccaagcaaggtaggagaacgtcgcatttagggagggtcaggccctctggcctggggtagatctcgggactgcccgagggcctctgacaacttttcagcatctgccccagggctgccccagctggagtttttgggacgcttttgtgggggcaccgctgagtccggatagtgggacccaagtcgtcctgctcggcccctggggaataatcgtgtggggcgcaaggtctgtgggaagggacttggagaggagggaagatgtcacgggagtctgcacagggtttccatgtgttccaattttgtcccataattgaaagcttgtggcattctgtggcggacggctacggagctagctcttccctttactatttcgcacttggtcttggaaaagtatgttgtcgctttaagatgaagttgaaattttatccctggtgctagagggtcacacaaagggagtttcccacctgccccacctgttttttgaaggactttacacccaattactaagtattaaaacaaaacaggtcctgcatggtagctcatgcctgtaatcccagaactttgggaggcaactactgaaaccctgtctctacacacacacacacacacacaaattaaaaattaattgggtgcggtggtgcctgcctgtaatcccaggtaggtggggacttacggtgacaacaacattatcggctatttttgtaactatttgtagagacgggtttttggcatgttgccaggtggtctacagtcctaaatcagtgactactgcttggctcaa

SEQ ID NO: 84741 - DNA, 702 bp, Homo sapiens
agcgtgggaggaggccaactctcggggcgctccctagccctgggtgggtggagcgggggaagcggagtacgttggacccggctccgccctaccccacggggccgcctggagaggtgctgggagctgggtggagcttagaggaattaaactttggccctgcgcctcgtccagcctaggttccacccttttctgggaacgtgagtatcaaccaagcaaggtaggagaacgtcgcatttagggagggtcaggccctctggcctggggtagatctcgggactgcccgagggcctctgacaacttttcagcatctgccccagggctgccccagctggagtttttgggacgcttttgtgggggcaccgctgagtccggatagtgggacccaagtcgtcctgctcggcccctggggaataatcgtgtggggcgcaaggtctgtgggaagggacttggagaggagggaagatgtcacgggagtctgcacagggtttccatgtgttccaattttgtcccataattgaaagcttgtggcattctgtggcggacggctacggagctagctcttccctttactatttcgcacttggtcttggaaaagtatgttgtcgctttaagatgaagttgaaattttatccctggtgctagagggtcacacaaagggagtttcccacctgcgacctatgagggacctctagaacaccacac

SEQ ID NO: 84742 - DNA, 1112 bp, Homo sapiens
  misc_feature (598)..(598): n is a, c, g, or t
agcgtgggaggaggccaactctcggggcgctccctagccctgggtgggtggagcgggggaagcggagtacgttggacccggctccgccctaccccacggggccgcctggagaggtgctgggagctgggtggagcttagaggaattaaactttggccctgcgcctcgtccagcctaggttccacccttttctgggaacgtgagtatcaaccaaggctggagtgcagtggcaccatctcggctcactgcaacctctggctcccaggttcaagcgattctcctgcctcagccccctgagtagctgggattacaggcacgcgccaccactcccagcaggaaactgctcaacagtcacatcttgaaagtaacttgaggcaactgcaggagggctgcatggcgggaaagaaattgctgaaaacaggctgggtgagctggctcgtacctgtgatcccaacactttgggaagtgaagttgggcggatcacttgaggctccggtagattgcaaatgacctgctttctttctgttcccgggcgtttggacccctgtcttggaccgctgtcggatagtaaatcccaagtaaggtacctgccgtcggcantttgagctttcttcttggacacctaatacccagagtcctccaggctccggtagattgcaaatgacctgctttctttctgttcccgggcggcatccggacccgtcgggagaagtaaatcccaacgtaaggtacctgccgtaggcagatttcgacgctttcttcttggacacctaatacccacagtcctccaggctccggtagattgcaaatgacctgcttttctttctgttcccgggtggcatcgacccgtcggagagtacatcccaagtaaggtacctgccgttggccagattcgaagctgcattcttggacacctaatagcccgaaagtcctccaggtaagatcccaaaggcaaaggtacctagcggttgaggcgcagttggcagctgttcgtccttggacacactaaggaaccgacgagtcttccagggtaaattcccaagcgagggcacgtgcgcggcagcaaatttgcagcctagcttcattgaacacttattacccgaaggcctctcag

SEQ ID NO: 84743 - DNA, 743 bp, Homo sapiens
agcgtgggaggaggccaactctcggggcgctccctagccctgggtgggtggagcgggggaagcggagtacgttggacccggctccgccctaccccacggggccgcctggagaggtgctgggagctgggtggagcttagaggaattaaactttggccctgcgcctcgtccagcctaggttccacccttttctgggaacgtgagtatcaaccaagaatgaatctcgctgtgttgtccaggctggagtgcagtggcaccatctcggctcactgcaacctctggctcccaggttcaagcgattctcctgcctcagccccctgagtagctgggattacaggcacgcgccaccactcccagcaggaaactgctcaacagtcacatcttgaaagtaacttgaggcaactgcaggagggctgcatggcgggaaagaaattgctgaaaacaggctgggtgagctggctcgtacctgtgatcccaacactttgggaagtgaagttgggcggatcacttgagggtcttactctgtgacccacgctggagtgcaatggcaccatcacgacttactgaagcctccacttcccgggctcaagtgattctcacacctcagcctcctgagtagctgagaccacagagacggggttttgccattgttgcccaggctggtctccagctcctaaactcaagtgactacctgcttgggctccaaagtgctgggattacaggcgtgagacacgggcccgggccg

SEQ ID NO: 84744 - DNA, 858 bp, Homo sapiens
gaaggttaaaagttacaaaataatttgcaagtgaaaatattttgctataactttaaaattttatttaagtaaataatatgtaactaaaaagtaaagcatcaaacaaggaaatatttgtgtctaatacttaggaaaataataaatgtcaatatttacagatgctgtgattatgtaacccactcctaatcactcctaatcagtcgtaatagagatattaaaagtgatcatataatatgaataaaattaagataaaagtataaacttaggtcaaccttctacataactccaataccaaaatagaaaatattttaggaataatattgaatcctcaatagtagcaacaagtaaaagatataaaatatataatcttttttttacaaagtatggttgcaaataagtagtatgaatatgaagaccactaaaacacttcattgagagagtttaggtttgaataaatgagttacaatgctatgtttttggatggcccatctcagaattgcaaatctgtcaggtttttcagaagtatttatagatttgatgcagtcccagtcaaaacaccttctcattaaaaaaaaattgataggtataatcttggcaaaagttttctaaatcaacaagcatcataaaggttacagtgaatcagacattctgctacattgccactggcatggtgaatcagtacttcccttgtgaaggaaaatttgtcagggaagagtactcacaagcctttagattgtgcagcccatatgtccctgaaatcatacttctgagaagaaattccaaggatatcatagcgagtcatgaattgcaatacttaccatggagtttttcatacacctggaaatacacagatgacca

SEQ ID NO: 84745 - DNA, 772 bp, Homo sapiens
gccgtgagcaccagctccgcctatcccctctgcagggcagaagggacagtgctgcgggaggcggaggtgctgtggctctgggaaggctgaaaagggacggctgcaaaggagaagagcttcgagtcctttccatcaggagaaaaacccggtcagctgtggaggagcactgcacaggagtcagaaagtggagtctgggcgtgaccttgcacctgaccagcctggggctctaggtccgccacatctggactaatctcctgtgtcctgagctcccaggaccccagaggcaagcatggaggggccacgctggcagaacccacagtggcttaggacgagctcctgcacagcggcctgtttcccaattgcatcgtgtatctctttgcctctcttggctcagccatggccccagccccaggccatccaaggggcagcctggtgaggtttcttcaactttgctaatgacttgacctacagtcttaagtcaagaaggtgtcgctctcctttgtgatggctggacgcacaggagctgtggtcaggatggggctagaggagctgaaatcccagggcaacaagggtatttaaaaacacatcgcaggagaaacagctaaagagtcttggaaccaggaatcataagctgtttgatgggatgaactatcttgggagtgatgaggtccccatcactgaaagtattcaagcagagagagtcatggaattaggagacggaagagcatcagacactgaatgaagtctgcactacatgagatgaagaaccctt

SEQ ID NO: 84746 - DNA, 382 bp, Homo sapiens
gagcattattggtccaagagtcattattttgaattatttcataacaaaattcataaaatatacttgatttatccttgatccactctcccaaaagaaaaacaatacaatagggaatacagcaaaaaaaaaaaaaaaaacccaaaaggctgaaagtatattttataaagcagtaacctacgtaaaactatcctgtctctttaaagctttatagcacttgagccagatccaaaatagaagaaaacttgagaaagagagtgagagaaaattaagtttttgtcttcatgaatgttcatgtttcaaacctaaagtgctatcaagaaaatctttgtttttttctgaagagatggtatcttactctgtcacccaggctggaggcagtaac

SEQ ID NO: 84747 - DNA, 156 bp, Homo sapiens
aagttgctgggtccctttttttgccgggtagtcttccattcactgtatggatgtaccaaagattacttactcatttaccagtgggagaagttttcagtgtttccagtttgggggtattacaaacaaagctttatgaaacaccgctatacaagtttt

SEQ ID NO: 84748 - DNA, 456 bp, Homo sapiens
actctttttaaaatcagcttgaattttaagttctggggtacatgtccagggtgtgcaggtttgttacataggtaaatgtgtgccattgtggtttgctgcacagatcaacccatcatccaggtattaagcccagcacccattagctgttcttcctgatgctgcccctcctcttgccccccactccagacaggccactgtgtaggttgtcccccacatgtccatatgttctcattgttcaactcccatttataagagagaacatgtgatgtttggtatatgctcatattcagtctgatattttttcttttaattatctcttataaccatatataatctaattattgattttttaggtgcaattatatcatttttttcttggcttctcctatttctcctacatggtatgtttctttcactgtctactccattttttatcatcatacatttttccttagc

SEQ ID NO: 84749 - DNA, 345 bp, Homo sapiens
tttgttccaaatccttagaatttccagagcagtaagagtgtcttttgtatgctaacaagatgactcctggctggggcctctagattgcctcaggataagggctgacagcccaaaaaaccacaaggcaggaggctagaacttctttggggattggggtaggatgtctcttaatattttgcccagactgggtttgaacttgcaatcctcttgcctcagcctcccaaatagctgggaatacagggctgggagtactgttgggcaccaccatgcccagcaagggctggaactttcagctccatccagctcaccccacccccaaccctccagggagaggagaggggctaa

SEQ ID NO: 84750 - DNA, 652 bp, Homo sapiens
ttcagttgtatgaagtacatttatattgttatgcgaccatcatcaccatccatctctagaacttttttcgtcttgcaaaactgaaactctatatccactaaacaatcaatccccattcccctagcccctgagaaaaccaccattctaccctgtctgtgattttaactacctcaatcatgcagcatatgcctttttgtgactggcttattgcacttagcataatgtcgtcaaggttcatctatgtagtagcaggatttcattgttaaggcttgataatattccactgtgtgtatacaccacattttgcttatccattcgtcaatggacagtgttgcttccatgtttgagctactgggaataattctgctatgaacatggatgtataaatatgttagagacactggatttggcactaattttttggatatgacactaaaggcaaggcaactaaagaaaaagacaaacgactttataaaaattttaaaaattggtgcatctaaagacattatcctattgataataacattatcctattgataataaacaggcaaccagcagaataggagaaaatatttgcaaattgtatatatgatgaaggattgatatccttgatacagagagaactcctaaaacccaacaacgagaaacctga

SEQ ID NO: 84751 - DNA, 196 bp, Homo sapiens
cagcatgtccggtggaagagccaggtatctctgaagccagatggacctgggttcaatcccagctccaccccttactcacactgtgaccttaggcaagcatcctggcctctgtgcctgccttctcagctgtacaataggatagtgaatcccaccgcaggggagcattgtggagccgaagcgaggcaagctgaaatga

SEQ ID NO: 84752 - DNA, 502 bp, Homo sapiens
tgactctagcaggatcttatccccgggtctgggtagtggacgttggtagtcaggggccctctccatggcggggaccaggctaggccactaactgagctgccataaaccctcggcatccaggagttcccaggccagggctctgaccaggagggcttcctggaggagatgggctgtagaataaagcagaagggaaataaatgcataactgtccattcactcatctaacagacatccccagagggctccctcctggtcagagccctgtgctggacaggactaggcacccagacagagtactgcccccacctgctgccagccctgggggaaagacagacaagtgcccaggtcactgtggctgtgtgctcgagcagtgctgtaatggtggaagggtagacagtgaggggccaactttactgatagcccccactttactgatatcccccacctcctagccaaagaagttggggattgatttatgggagggagcagtttggcatcaagg

SEQ ID NO: 84753 - DNA, 1926 bp, Homo sapiens
  misc_feature (1277)..(1277): n is a, c, g, or t
gaaggatgcatctagtgcaggacccattcatcaagagatgtaagtacattcttcagcttagcttttcaagcatcaagtagtgtttctattctgtatttcagaagatattatggcatagtttaaaggggtgctagcataggacttaggaagactttttttcaaatcattgctttgattttatcttcataattgtaaaaaatcatgttatttttctgttcctgttttctgaaggaaaaaaacatcttcttctaggtttgatataatgtttcagtgagaacagcacacagtgggagtggcccagtgcctggcctttaaacatgcttaataaatgttacatgaatactgtatcctgctttgatcaccactggcattttgtaatggaattagttcttctttttttttttttcttcaacttttattttaagttctggggtacatatgcaggatgtgcaggtttgttacataagtgaacatgtgccgtggtggtttgctgcacaggtcatccatcccatcacctaggtattaagcccagcatccattcgctgttcttcctgatactctccccaatccaccatccccctgcctcctgccacatgccccagtgtgtgttgtttccccccatgtgtccatgtgttctcatcattcagctcccacttattagtgagaacacctggtgtttggttttctgttcatgcattagtttgctgaggataacggcttccagctccatccatgttcctgtaaaggacatgatctcatttgtaatggagttagttctaaatggaccatttatattgttcaacagacactagagaatactattcattttgcatgattctttggtcaaggacatactgtaagctgcgttagtgttctccttggttaatatctgaactgaccatgtcactccaactcttatagaccagaattcatttataaagcagaaagataagccaatatgagagaggttatgaagctgatgtttgatttctggtctcctgcgtggagcgatgggcctattgccaaccagagttggtcgggaaaaaggaaagatgactcctaccagtgtacttacgctttatgatcttgaatattttcagtgtttaaggaatctcttccttctttgatctccactgcatgaagaactctgttgcaggtgttaacaaggaagtttgaaatagaaagccagaacctgccccccaaagatctgacagtagtagaaggagatccattatgaagaaggtataatggcaacaaaagaataatcacaaattacntgtgtgtgtaatatgtgttgtgtggtgtgggtcaaggagatgaggaaggtggttagggaagactttatggaggaagtgagctgtcaacaggaattgaaggtgagaagaaaagttggggggaatccatgttaatgactgtctcagtcatcttaaactaggttatgctgtgatagcaaaaccccagtggttgcaacagcagaggcttattgcttgctgtgctgtgtgtctactgtgggtctgctatagttctgctccttcctgtcttctgtcctatacccaggaagggtggaggaggaaaggcaaacctggcaaaccattcataggctctaagcttatgcttggaaataacaggtgtcacttgtgcccacatttcattggccagtgcagatcacatggccacacctgagtttgcatataaggaggcatccttcttctgtagagactggtaccacaagtcatgtggccaaggctgaggtcatggggcaggcagatgacacatagtcctcttctagggaggggcagtgaatcatctaccaagacagcaatcaagaagggcaataatgatgcattgacaggcagggtttcccacttaaaatgttttaaaactgaaagtctcttgttcaagttggtgtttggattaaaaaaaaaa

SEQ ID NO: 84754 - DNA, 266 bp, Homo sapiens
atgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagacccatccttggctgctt

SEQ ID NO: 84755 - DNA, 457 bp, Homo sapiens
actgtttttttctttataacatatatctttataggggatagtttttttaaagacataaattttcttttctgaagatggaaacatacatattattaaatcatacttccatggtaaaacactgcctaaacacttgcactttagaaacttcacatcctacaatgtttccatcacttagccagtgtctccatcttattaccttgaattactctaagaaaatgaatgatttactgagaatttttttaatgataatttaatttccttaagcttttataatcaaaatcattgtaaaagcagactgttaccaaaatgagcaactccttcatcttattccaaacatttttatattttgctattcaataaatttaagtctatcttagaccaatccatgatagtaggattggaagaggaggtagaggttgactagattagcattcaggttaatagactatgaatagtg

SEQ ID NO: 84756 - DNA, 267 bp, Homo sapiens
ggagaatttgagctaggtgtcttcaagttacctataaactttgaggttttattaaatatgccgaggtttacaggtggaagaacaaaaagctaattgagtgaaacaaactggttaacttgataatagtttttgccttcctggataaagagaaatgagtattaagtgagaaggctatttaatgaagggctttaaaccacactgtaatttggtagattcagcagctttaaaaattggcataccttctgacatggaaattccctttaaaga

SEQ ID NO: 84757 - DNA, 658 bp, Homo sapiens
ttttgaaagatttaaattataagaaaacgtgtagtacatgttttctaaatgccatttccaatattcgtttctttgtgtaggcccacatttttatctggtatccttttgcttctgcctggaggactcttaagatttcttgcagcatgggttggtgaattcttttagcttttgtattttttcaatgtccttatttcactcacagttatgaaattttatttttgcatagaattctagattaactttttttctctaggtactttaaaaatgttgccatttatgaagcattgtcatttaaaatatcacctttctttcctatgtttgtaaatatggcgtaaagccggtttcttgtgctggttatacaattttcagaatgtgtatttaaatttaaaatattaaattgtactaaaaaactaaaaatattaatcatgaatgtcctagattcatcttaagttccaacagtacacttaaagtgtgcccaacctgagggtcaaacctacttgctgacatggaatttgtgtttgtgagagcctagtgattttccttacatctgaatgtcttcattgcaaaaggaaacgtttttctttgccaaaatactttaaaatattcttacttcaattaagtgcattaaaaacaaatttctcagttgcatccctgaaat

SEQ ID NO: 84758 - DNA, 413 bp, Homo sapiens
atttgaaaattaagagagatgaaagattatgaaaagttttcctcccattctgttccctatcttccctgtttccatgacaacccctaaaggtaactattactagtttcttttgtattttttcagagtttctaaaattttatatgtataagcaagcatattaaatatagattatgtctttgtcatttataaaaaagatatcattcttttcttattatttgtgcccttgcttttttgcataacaaaaataccttcccattccacacatagagagcttcctcattaaaattttataggtatatagtgttacattttatggatttatcctaatttgtttattcaatccctgttgatggacattgtgcttgttttcttccattcactattagagctgtagtgagttaccttaaactgtc

SEQ ID NO: 84759 - DNA, 470 bp, Homo sapiens
ggggagtggagagagaacgcatggaaaaaagtaaattaaataccctgctccttgagaagaaacaattcttgggaaggtgctgtatgatcaaacactgggaatgcttcttggtatcttttaattttttttttaacacagacgcatttggatatttcaaccaacagtttgtaatataaggataaattttatggacgtagatatccaccttctctctccactcccagggagagagaaagaaagacaagaaaagaaaattcaaaattcatgcaaacttcgtgttgcagcctaaaactgtctacagtatatcaaagcaaaggcatgtaaattcatcctctaaatacaataagcaggtgagaagcaaaatcaaaaataaatctcactagataaaaatggaaagcatttaacacacaatcgtacaaggtgaggagtattttttattaaaagctttttagttactttctctctccact

SEQ ID NO: 84760 - DNA, 538 bp, Homo sapiens
tgagttccccttttctgcagtctatttttccatacatccaatttatttaacaaagtggagcctcatctgaagcatttcctcacctgaaaaatggggataaacaaatgaatctctagcgctgtagaaggcaatcatgttatttactcagcccacagcaggccatgaaggaagctcctcatcttcctgatagctgcaaggccgtctctgtgctgggctctatgtggtgccttatatgccctagattcactctccacccttcagctttctccaccctcttctgggccccaggaatctgtcctctgggcagattcctgagacagtgccactgggctcccttgtcctctggtttgctgttgggtttggccaatgggaggccctgataggagattggaaggagaaagaaaggagagacacaccgtttaatttcctgcttcctccctgccagcagcagctgctgctgctctaacaaggcctgaagactcttctcagggagccctctctttgagctacttcttattctgggttccagtaactgcct

SEQ ID NO: 84761 - DNA, 210 bp, Homo sapiens
ctgcaactgaatattcaatgggttaacaggagagggctcctagccaagaatggggtgactccagaaaggcatgtgggaggaggtgacgtctgagctgaagcccaaagaacagtttgtaaatcactgggtttggatgcggaaagagtgtcctgggtgaaggggacagtatgtgcaagactcggaagcaagactgacgtgttccgaaagcaa

SEQ ID NO: 84762 - DNA, 570 bp, Homo sapiens
ttttttatatgaggaggtaagtgggccagctctctgctttttagggagagacgtttattttctaaggctgtactcaaacttgctctttgttctagagaaagatatctttatcttccaaggctgttcgctgtacaaatgtccttgaaagtctaaaataaagtaatatgttcacaaaagacctgaaggtcttttcagagatctttataggcactgaaatagtggggaagatttagttattttgagaatgcaaaagtaaatttattttttttctattaaattttactttcagcacagtggctcacacctataatcccaatactttggaggctgaggcaggaggatcacttgaggccaggagtttgaggccagcctgcgcaacacactgaaaccctgtctctacaaaaaattaaaaaaaaaaaaattagccgggcctgggagcacatatctatagacacagctgctcggggtctgatgtgggaggatcgcttgagcccaggagtttgaggctgcagtgagctatgattgtgccactacactccagcctgggtgacagagcatgaccctgtttct

SEQ ID NO: 84763 - DNA, 1346 bp, Homo sapiens
agtcatttcaagtggggtggggagttaggagtggcagtgtctaggactaattctcacctggaataaggacaggctctgatgggttaaataccttttgatttgcattgtagttgctttaaaccggcttcagctgaatctcttcctgcaggtaatcacgtgcacacacacaccaccttcctgagctctttgtgcctttctctcagaaggttagcttttctgggagggacctttctgttgagctcttggccaccccgacaggttcaccttgcagatgcagaaagcagagtggacgcggcagccttaagcagcggggctgcgtgagctccaagaactttcctgtgggctttcttgggagcctcaagttggagctggagtctccttggtttacaaacccccgtggtgtgagcgtacagagcaggcgggtccactcattgtgctccaaaagtgagtgtgacatgtttggtcagcagcaggcttcaatttggctctacggggattgcagaattggtgtgtaagttatctttaaattggccgattgttgagcataagtataaatttcctctgtttgtttgggaaggacggtccttagtaaggatgtgatggccagccagtggctccagtttcccgtggaggtggatgctggcccttctctcgggccagctgtgcaccaccagcccatccagccatctggactatatccgtcagttcagtcttccactcgctaatctttagctggtacttgtggctggaatgattctcagtgtggtcagaaatcatccatcctgtgggtatgggatagagcggagctgcaggaatctgccctgactggctgctgtctttcaaagacttgctttcatgtgtacgttcttaacaatgaacaccggtgcacagctgggcatggcggcacacttctataggcacagctactctgaaggctaaggcaggaggatcacctgagcccgggagttccagaccagcctgggtaacgtagcaagacccctgtctcaaaaaaaaaaaaacaaaaaacaaaaaaacggaaagaaaacctacacacaaatgaggccctggccttggctagtgatataaatcagaccaccctgatacttacccactgcagagaccacagggagctctgacaggacacccacaagctgctaccagcttcctggacgtaaccctttccacctattctgtcttcacgcagagttcatggtcctatccctctttgcaaatttagctctctctgcaagaagggtacctcttcaagtatgttttccagaaaaatcattcttttccccaccagaccagctctttcaacccagaaaaattaaagttgtaaattcttc

SEQ ID NO: 84764 - DNA, 248 bp, Homo sapiens
tacatgactgcgtacatttgtcaaaactcatacctaacttaaaaggttaattttactgtgtgtatattatacctcaataaacctgacttaataaataaaatccactaatgcccttcaaccatggttaacacatatcaagctatataagtagtcttatggaaacccctgtcaccggaattgagtgccagcttacccaatccatttgggtggtgaaggttggtaattacagtatagcatagctctctcta

SEQ ID NO: 84765 - DNA, 285 bp, Homo sapiens
gggattcactgttagattaatgttccctttctaaaattaaagtgaattcagttttaagaatttcaggtcttccttggctgtgacaaaatcatgctctggtatttttcagtttaggaaagaagagaactttgacctgaactactcttagatttttggcagggcacagatctagtagtaaacaccgtcttacccttgagactctgttctcccagctgtgaacagctattgcaccactcccaagtctaccactctggagagctctgaggaggaacaaggtttatttgt

SEQ ID NO: 84766 - DNA, 599 bp, Homo sapiens
  misc_feature (196)..(196): n is a, c, g, or t
atcaagttgacactcagtattaaccatcacaataagagagaattggctcacacgattataaagcaaagtcccacgataggccatctgcaagctggggaaggagagaagctgatagcatggctcagtccaagtctgaaagcctcaaaaccagggacgctgacagtgcagccctcagtctgaggccaaaggcccaggnagcctctgggaagcaattggtgcaagtcccagagtccaaaggtggaaaaacctggagtctggtgtccaagggcagaaggagaggaagtcaagcattctgcacagcacaggaagaaagagagggagcagactcagcaagcacgctgcttatctccattcgtccacctgctgtgttctagcctcactggcagccaactcgatggtgcccacccacactgagggtgggtcttcctctcccactccactgactccaatgtcagtctctgtcagcaacaccctcacagacacacaggggaacaatgcttcatcagccatccaggtatctctcaatctagttgacacctaatattaaccatcacaaaatgtaagaattctttacattttcaacatttaagtccattatc

SEQ ID NO: 84767 - DNA, 865 bp, Homo sapiens
tgtcttccttgcttttcctagaacacagcaagcatgcttttgcctcagggactttgtacctgctgtcccctctctgactagaaaacagtttccctagatacctgcatagttagccccctgaacttatttcaattctctgctcaaatgtcatgtaaatggtgacatcttccctgaccatcttatataaaataatacttccctttcccctgatattctctatccaccttatcctgtttgatttttctgcactgccccatcaaccattgacatataacatgtctacttgtttatatatgtattgtgtttcaccagcattgaaatgtgactttcacgagggtagggatttttgtctgttttatttaatactgtatccccaagaatgccttgcataaattgggactaacaaatatttattgaattgaataaatgaatacatttgggaaggcgcaaaggagtccttgcccctgaaattcatttcttcagtcagccagcaaactgtatggagtgacatctgtgtgctgagctcagagctctgtgcctgggatagcattttacagagcatggtgggcatggctggccagtgctcctgcttacttcgattttctgccttcccaccattcctgtgcttattatattctttctcagaagactttttccccactgttgagaacagggcagtctgagaagcctccctactaaaactgaggttggcacccctctcctacttcattgtggaatcctggaatggtctttcttaccctttgtccctagcagtttcacatgctttgggtcattgcatttcttcccttctctgccctcccccacttctctccttcaaacaacatcatctctcagcaatatacaa

SEQ ID NO: 84768 - DNA, 441 bp, Homo sapiens
cgcagagcagagggtggaaaggcaaagagtacaagtgagcgagccctttttgtgatggcgttgatctgtttacaaggggactgcctaaacactttccattagcccccacttcccaacactgttgcagtgttgcagttaagtttccaacacatgaatgctgggggacacatttaaattagagcagtgatgatcagaaagttattgttgggaaaggaggttctattttaacttaagtagcttgaaaaagctcttcaaggagttgatacaagaactgagatttgaattagaggaccgagtaaagtgaagaatctgcgggcaaagtcccaggcagagggaagagcaggaaatgattcatcagtagacttgctctcccattctcggcaagggctatttcacattttctccactctctccctcagcacatctccacctggctttctc

SEQ ID NO: 84769 - DNA, 491 bp, Homo sapiens
ggcgagtggagagagaaaggtgagtcaaaaagcagcactactgcctccggagcaaatgaatgggaataaaggttgatgataccaggtcaggggagtggagagagaaggtgggtcatgtgtcaagtagacccctgtgtctttcccaaaaagtattgaggtgttttggataagcttggggacagaaaccatagaaaagagcagggtcctagattctgaaaacacatctgccttcctctgcacagttgtgctggctgttgcaggtctgtgaatttggaagtccctcagtggctattattagttttaatttctgtttgtattgaggacatttccacatgtttattttggtgaactttttgagatttaagattttataaaaaatctagtggtcaggaggggcttaaaaagttcaaatcatatactattatatctagaagagaacttagaaatcacctagttccacattttctttgtaaagataataaacagaagct

SEQ ID NO: 84770 - DNA, 416 bp, Homo sapiens
gtctccccagtaatactgcagccttcttaatgacgagattatagattccatttttcatatccttcacaacacacctagcacaatgttggggtagggttagagtggacctcaggtatctggttcataacagaaattctggatgcattttctgttcatcttaagaccaaaccctcatccctgaaatgtctttgggaactccatggatgcttagacagttttaggctttggggtgacttgagtgtgccctcctggtctctatccctcacctatctctggttcatcctactctagagctaaatcttcaggttaggcccaggctgaactggcctctggaaactgtggtcaatataactttcatccagtgactctcttccatgttgggtctctaggtattatggaaccaaaaagaagaaggt

SEQ ID NO: 84771 - DNA, 223 bp, Homo sapiens
tataaatatataaaaaggcttctacaccaagacaaaatgggatttctcctaggaatttaaggttggtctaacatccaaaaatcaatattaatacaataatataatataatataataatcaacattaatagaataaaggacaaagcccatacaattatctcagtaggttaaaatataacatttgaaaaacattcaataatcattcacgataaaagataaacatt

SEQ ID NO: 84772 - DNA, 274 bp, Homo sapiens
tatttgtcaaaaacagttaagggtaaatatagtagcaataacggggcaaacaatcaacacagtaaaaagcctgggaagaaaagctggtgaaggagatgctttgagagtaagagctttgaaaagctcccacatatcctggtagtcctagaaagccataggcatgtcagtgctgagcagatgttcagaaaagacctgaaaaggctctaagttttcacctctggctcaggctctgcccatgcaggaagtgaaggcaaaggcagagctgttgaaggtg

SEQ ID NO: 84773 - DNA, 219 bp, Homo sapiens
agcaagactttatttcaaaacaaaacaatactatacaagaacctttcagcaggaccaaattgatcaagattaccagaaagtgggctcccttcgtgacagggcaggactgcatcacccaccaccagcaggctgtgcagggcaaggtcctcgcaggggctcaagttgggtatataggcagcttcagtataatatgccttagcaatccacttaaaaaaaaaa

SEQ ID NO: 84774 - DNA, 293 bp, Homo sapiens
agaacacctttcagggtcagacagcactgtgccacaccagtgccaagggaggctggcatccatgggataaggaggtgctatgtagtcattcaaagcaatgccatctctatgtgaagacctggatgaaaatccagaatatagtggttttacagcttataaaatcatatgtgaaaatgcaaaaatataggtgtatgaacagtgtgaaaagttataaccaaaatgttaacaatagttactgttaaattaatctggaattattttagcatatacgagatgacaaaactattttctcc

SEQ ID NO: 84775 - DNA, 381 bp, Homo sapiens
ttttcctagcatgcgccttaaaactctctcagcctttacctattattacccagttccaaagccacttccacatttttagatatttgttatagtagcaacccacttctggtactaatcttagtttgtgctgccataaccaattattttactaggtggcttataaacagcagaaattaatttctcactgtactgaagcctgggaagtctaacatcaagcaaggcatggcagatttggtgtctggtgaggaccagtttcctggttcatagatggccattgttctgctgtgtcttcacatggtcaaaaggcaagagaaccctctcatgcctctcttacaagggcaccatctcattcataagagctctacctccatgacataatca

SEQ ID NO: 84776 - DNA, 867 bp, Homo sapiens
gatgggtggtaacgttcagcaaaagccatgcccaggagacaggcacagtacccatggagacccagggccagctgatgacagtgatgaattccctttagaactggcggactcttgggtgcttggagacactatataaataaggaactctggctgtgtgcatgggagagtatattaacagggcttggcctggctgtgaggtgcagagatgccgtttctctcaggtaaggagccatattggggcaggggtttcctaatccttttttgactcacaaaatacacctaggaaatgttaaataaatagtcatttttgagtagtatatgataaagaagtgattgattttgactaaaaatattcatgttctatttttagaatatgaaagattgtattataaagatcacttgaaataaaattttagataatatatggagacaaatttctgctttttacatttaacttgctgtttaatgtatctcaaattatttatgtaagagatatatgatttgaccaataaatataaaaaaatgttataccataatctggggacctaaagtacttcactttttttgttctgttttgtttttgagacagggtctctctctgttgcccaggctggagtgcagtggcccaatcatggctcactgcagcctcatcctcctgggattaaatgattcttccacctcagtctcccgagtagctgagactacaggcacatgccactatcgctggttttgttgttgttttgttttgttttgttttttgagacagagtctctgttacccaggctggagtgcagtggcacaatctcggttcattgcaaccgcctcctcccgggttcaagcgattctcatgcatccgccttccgaata

SEQ ID NO: 84777 - DNA, 102 bp, Homo sapiens
gtttctcctacaaagctgctggcctgtgggaggttcacctgatccccgtgttagagtcctggtttgctgcatcacggacttcatcaggggctgagtttgctg

SEQ ID NO: 84778 - DNA, 689 bp, Homo sapiens
tcccttattcaatcaaaggtaatgtatattacttccaaagtataggagtattaatttaagctgaccaaaaaaagaggacccagatactcgtttccaaagatgttttgaatccacctattttcaaaaggccaaatttcattttacagctcttgtgaaaccaggcaagcagtgtaaattttaaaatgcagcagtgggatatcttcaaatgtagcagtgagatttttaaaatgtagttgtttcaaaactgatcagtgaccgtctaaaatacgggctccttgaggacatcctgcgcctggttcatcctttttgcactctcaaagtctagcccttcccagatgggacctcagtcccagcccccctacactgccatcccccagatctttagggcagtagggttcattgacaaggttgcaggctacaaacttggcaaagtttatactaacacctcattccatcccacctcccatcttaaaaaggaaaccgttaagtatcttattctagtgacttcaataaaggaactaatttataagacagccaagaacaattaaagtcataaagggccaaacattttattttcatctaagaaccgtttgcaggggtggtccgatcttttggcttccctgggccacactagaactgtcttgggccacacgtaaaatacattaactagctgatgagcttttttttcc

SEQ ID NO: 84779 - DNA, 337 bp, Homo sapiens
gaaaaaatgagaacaagggtttgcaaggtaagtataagaaagagcctgggttctgaccgggtgcagtggcccaaacctgtaatcccagcactttggcaggctgaggcgagtggatcacctgaggtcagaagttcgagaccagcctggccaacatggtgaaaccccatctctactaaaaacacaaaaattagctgggcatggtggtatacgcctgtaatcccagttacttgggaggctgaggcagaagaatcacttgaacccaggaggtagaggttttagtgagctgagatcacatcattgcactccagcccgggtgacaagagcgaaactccgtttc

SEQ ID NO: 84780 - DNA, 2341 bp, Homo sapiens
gaattccgggaacagaaggcgtcggagcgggcgtcggagctgcccgctgtgggagagagaggagacagaaagagcgagcgaggagagggagcccgaggcgaaaaagtaactgtcaaatgcgcggctcctttaaccggagcgctcagtccggctccgagagtcatggcgaccgcagcgtctaaccactacagcctgctcacctccagcgcctccatcgtgcacgccgagccgcccggcgcgcatgcagcagggcgcggggggctaccgcgaagcgcagagcctggtgcagggcgactacggcgctctgcagagcaacggacacccgctcagccacgctcaccagtggatcaccgcgctgtcccacggcggcggcggcgggggcggtggcggcggcggggggggcgggggcggcggcgggggcggcggcgacggctccccgtggtccaccagccccctgggccagccggacatcaagccctcggtggtggtgcagcagggcggccgcggagacgagctgcacgggccaggcgccctgcagcagcagcatcagcagcagcaacagcaacagcagcagcaacagcagcaacagcagcagcagcagcagcaacagcggccgccgcatctggtgcaccacgccgctaaccaccacccgggacccggggcatggcggagcgcggcggctgcagcgcacctcccaccctccatgggagcgtccaacggcggcttgctctactcgcagcccagcttcacggtgaacggcatgctgggcgccggcgggcagccggccgggctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtagggacactccaccacaccacggggtgcagacgcccgtccagtgaactcgagctgggggaggggcagagcgcggggctccccctccccttcggtccttggccctttcccggccctcttgttccctctctaacttctgattgttcttttatttttaattattatttccccgtcccttaaaaagacaaaaaaaataaggcaaaaggaaagcaactaagacactggactatcctttaaaggtagcaggtgtaatgatgtgttttgacctttgcaggcgagtaaccaggcaatggagtggagtgtctcctggagagagtgaggagagtgtgtgatagctagaaagagagagagacagagagatggcaagcactgagataaatacctggcaaaactaaataaattaccaaaaaggaaaaaaaatccaccaaaccatgataaacacaaaatgcagcttcctgatgcttagagttggcacatgctgctgtgtttatttattgtggattcccatcaggaaagaggaaaaaatacacatgttctttcatataggcaaaatttaaccacataaatttgcactgcaagaaaattgaagtttacgtgaacaaattcatgagcatattttctctttctccccaccgttaatttgggagttgccgttttgggggattttgttttgctttgctttattcatcggagagagttgaagccagctcttggccactctccatttctaatgttcttgtgttgccccttcttcgtactgtttgtgaactttggttaccttcacattccccttacgagggtgtaacatctatttgttcctcttaccaaagcaaaaggattggcttcatacaaaatagacaattctctgatttcaggaaatgtgcatggtctac

SEQ ID NO: 84781 - DNA, 1997 bp, Homo sapiens
cgccgagctagtcagagagtgagcgagagcgagaaggagggagaggaggagaaagagagcgagggcgggcgggaggcggcggcgacggctccccgtggtccaccagccccctgggccagccggacatcaagccctcggtggtggtgcagcagggcggccgcggagacgagctgcacgggccaggcgccctgcagcagcagcatcagcagcagcaacagcaacagcagcagcaacagcagcaacagcagcagcagcagcagcaacagcggccgccgcatctggtgcaccacgccgctaaccaccacccgggacccggggcatggcggagcgcggcggctgcagcgcacctcccaccctccatgggagcgtccaacggcggcttgctctactcgcagcccagcttcacggtgaacggcatgctgggcgccggcgggcagccggccgggctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtagggacactccaccacaccacggggtgcagacgcccgtccagtgaactcgagctgggggaggggcagagcgcggggctccccctccccttcggtccttggccctttcccggccctcttgttccctctctaacttctgattgttcttttatttttaattattatttccccgtcccttaaaaagacaaaaaaaataaggcaaaaggaaagcaactaagacactggactatcctttaaaggtagcaggtgtaatgatgtgttttgacctttgcaggcgagtaaccaggcaatggagtggagtgtctcctggagagagtgaggagagtgtgtgatagctagaaagagagagagacagagagatggcaagcactgagataaatacctggcaaaactaaataaattaccaaaaaggaaaaaaaatccaccaaaccatgataaacacaaaatgcagcttcctgatgcttagagttggcacatgctgctgtgtttatttattgtggattcccatcaggaaagaggaaaaaatacacatgttctttcatataggcaaaatttaaccacataaatttgcactgcaagaaaattgaagtttacgtgaacaaattcatgagcatattttctctttctccccaccgttaatttgggagttgccgttttgggggattttgttttgctttgctttattcatcggagagagttgaagccagctcttggccactctccatttctaatgttcttgtgttgccccttcttcgtactgtttgtgaactttggttaccttcacattccccttacgagggtgtaacatctatttgttcctcttaccaaagcaaaaggattggcttcatacaaaatagacaattctctgatttcaggaaatgtgcatggtctac

SEQ ID NO: 84782 - DNA, 489 bp, Homo sapiens
gtcgtgtggtcatttgtactcctgagtgctggccaccaggtggctgtgcccctcagtgcgtctctccattcttccttgagggacactgacaggtttctgggttttggtgatgggcagtaaggctgctgtaaggtcgtccaggtctgtgtgtgatgggcggattcgtttccttcaggtaaacccttgggatggggttgctgggctgtgtggcaggtgcacgcttatgttagcattgccctcacacctttctcagtcactaggtgaccgtggaagtgtgtctgttttggggctgtctactgtctttcgagctgtgtgtccttttcctgatgccacactttcctgatgacttgaagtcttgatactgggagtcctccaacttcgttattctttctcaaaaaattgttttggctattctagctcctttgctgttccatgtagactttagaaacaatatgtcagtttctataaaaaattctgggctgggtgcag

SEQ ID NO: 84783 - DNA, 257 bp, Homo sapiens
aactacatgacaatgatttgctttgtaagcattttatctacattgttagctaactctgaatatacgtcattaaggcactcacctgagcacacacaaaaaaaggatcctatctaggattcacttcagtttttcttgggtgaatggcgcatgcctagtaatgtccactggaagattacagttcaggtccagagtaggctaacattcagctcatcaagttaacccccaacattatctagcttagtaccaaatgccaggaa

SEQ ID NO: 84784 - DNA, 427 bp, Homo sapiens
aggtcagtcttgcaaggaaaagtgtttgaggtggcagaagcagatgccaagttcttatcatgagtgactgcaagacagtatcagttaagacagccccatttcgagctgctgaaggcctgacattttaaagtcacagaggcctctggtgagaactgatcttggacgagtgtccttgtttgtgtctttatctgattggatgcaatctttatcttttttatttattaaacaaaacatcttatccttgttggcaaagtgccctctgaaacataaaatgaagtcttattctaagatggagtttgttatatcaagggtactctatacaatagggcatttttttatcgctaccattggtgaagtttaaatatggagtgttaaaatctagtttcctcaagttctctggaaatgcttgcctactcactcctctccg

SEQ ID NO: 84785 - DNA, 594 bp, Homo sapiens
gatgagctggctccctccccagctgtgaaatctctgagtctcagtttgcttctctgcaaaatgaggataataatccccacctcgggactgaggattaacgaggcaatggttttagcagaataatccactgctgctattattatcagcatcttcgtatagcaaaactcatttggaccaatggggagtgcgttaagttggtctgaagtagggcaaaggaacgattatagaatgtttcaaaggaaatgtgttttttattatttccatgtatatagagtactggaactgagtgctaggaggtggagaactgacttgatttaaataaggagagctcatttgacattggcctgtttgatttctcaacatccaactgtgttaataaagagggttttgagctatctatgtgcccagctctgtgactggagaaggaaagtcacataagacacagtccttgccctcacaggacgtgcaacctgtgggcagatgagtcctacacaggaagcgggggcaagaaggaaactgtgaggcactggggagcacggcgctgccacaggtgagaggaaacgcgtagcctctggaccttgagtgccaaggctg

SEQ ID NO: 84786 - DNA, 354 bp, Homo sapiens
ggtcctagagtcagaccacctgaaaggaggcactcagacctaagccctaagagcagtaacaacagcttacattttttgaacacttgctatataccacctgtgtgtttcagtagtaagcgatttactcctcacaaccatcctaatgaagtggggactattatttccccacagatgatgaaactggggcacagtaatgtaacttgctcaaagtcataagttgataggtgatagaggcagtttcaaactacgtactttggctccagagcctatgttctttttgattgtttagttctacatactcacagagcctatatttttggagggttttttttgtttgtttgtttgtttgttttg

SEQ ID NO: 84787 - DNA, 227 bp, Homo sapiens
gatctccttacactgctattccagaggagaagccaccaggtcactcaactcttagtatcatctactggaaactggctaagacagtatttatgtgcttctctcacaataacaggaagataactatatcacacaatggatatggcagttggcttgactgcagtaatcatttaactatgtatatgtatatcaaaacatcatgttgcataccttaaatatgtacaataaaa

SEQ ID NO: 84788 - DNA, 570 bp, Homo sapiens
ttctttttctttttttggagacagagtctcactctgtcgcccaggctggagtgcagtggcacgatctcggctcactgcaaactgcgccgcccaggttcatgccattctcctgcctcagcctcccgagtagctggaactacaggtggccaccaccacacctggctaatttttggtattttagtagagacggggtttcaccgtgttggccaggatggtctcgatctcctgacttcgtgatttgcctgcctcagcctcccaaagtgctgggattacaggcgtgagccactgcgcccggctgattctacatattccaaaaaagtttatttagtgctattatctgggggaccagttatatcagcagaaaagggcgactaagctgtcattatgactcaaatggttcaccaaaaaaagaaaaagggtaatttcctcctcctgaaaagacaacaaagcaactcttttaaaaaaatcatattctaaagcggtttattctaaaaaccatgagtgaggtactattctttttagtgagtacagttaaaaaggaaaacaaaaaaaaaaaactctccagggcat

SEQ ID NO: 84789 - DNA, 705 bp, Homo sapiens
gggctcaccaagggctgccagttcgcagaagtccctcacctttgttccacacctgctgactttctaaactgctgtcctctggactgtgctaggtacacatgacagcaccttggcagccatgtctttcagagccccgttatgcaatgccatggccctagaagcagaaggaaccatcaaagaaccaggctaaaggactttgggaccaacaggcattcaggaatgcacctggccaggagctaaggggccaccagctgacaagagttgccaccagacacgccaggtagaagatgtcagctggcaatggccatgccagcctaagctacctctgtggagtgaacaatgtagcccagaagagccagcacagatccctcccacctatcagccctgtcttcccccatcttgatgcatgtcccaggtaagcattcctgattctgctcacttgggacacagttctctaccctgtttgtgatctcaggacctgacacctgtctgctcaagccaggttccatggaggagcagaacttcatcctgctctgcatttagggcctgcctcggagacagtaggggagctcccaagaactcacaagtttggaaattaatatttctctttgcaagataaaatacagatcagcccaaagtacatcagacctgaggtccaattccaaacagaaagtcggccctgataatccctgggttaaaggccca

SEQ ID NO: 84790 - DNA, 263 bp, Homo sapiens
aacctggatggaatgggatactattattctaagtgatataactcaggaatggaaaaccaaacatcatatgttttcactcataagtgggagccaagctacgagaatgcaaagacataggaatgataacgctggactttggggactcagcggggaaagggtgggaagaggacgagggataaaaagctacatattgggttcagtgtatactgctcaagtgatggatgcagcaaaatctgatgaatcaccactaaagaacttactca

SEQ ID NO: 84791 - DNA, 2206 bp, Homo sapiens
agtcagtctattttgataaaatcaactgaaaaaacatttgcataaagactcaatgtaggggaaagattcttgacacaaatcttacattaaaagtctgttaatatttttattaacttttacaagatcctgttgtttttcatttactataagtcctaagtcaaatatgcctcacaccaagcatctgaaaagttaagtacagtttagtgtcacatttgcttgagcacatttgagtttcagactcatttaccattgtggaatctgcttttggatattagagatgtttgttcaaataccagaagacagaataatactatcttctaggctaaaactaattaattactttcatataatggacaggagaaattcacatcagatagatattttaccagttaatggtgcagcagaatatcaaactattttcttaaaatgaatcagataagaacattgctcataaaaaataacttttttgtttgatcaaaattatttatagttttatatgtataatcctagtttatcctgagatgtatttgcttttgctttttaaacttataatttaaaaaaaaagagagagagtcagaaggttgtttagatggagaccataacaaacttctgtttccctaaactcaaattgttactctagtctattgaaatacctgatccacttgagatctgccagttctgacatttgcaattccaaccttggcctactgagaatcatttggtgaactttttctaaaagttgccatatataaaaagatgtatattattatttcttctaaataatgcattatttcttctaaaaatgtgctgatgccataaaatgtattattgatatttttatcataaagcagttgattttataccttttacatatctcaaagcaagagggagatttgagagactcaaggtaaaaggtatttttagagagtataaattggtggttgactttagacgaatgcttcccaatgcatatatatgcacactacacatatatatgcatatatgtgtgtatacacacacatttttataacgatacctaatttaaattaatgtattcaagaagataaatgactaaaatagaacagaggcatctctgtctcctgagataaaattatcagcttgactaatagaataaagcactataggcatgattttttgcttccttatatatgcataactgatatgagtaaaacctgaaatcaccacactactcttctctctaaaagcttatagtaagtgcttgattatttaagggcatgggcaggatgttatatatattaaattttgagtatatgttaaattttttgatataaaattaagtcactggttgactgtaaaagattgttgttttttctattacaaataacagatctttgttttatatccatctactcctgccttttttccccaaatgcaactggagaaacttgtgtgtatgctagcatctagtcaatattagtcacactctgtggtgctagatgctatcaaattactatattagtagtagtgacatagcaactactataattagaaaaagatgaatggcagattttatgtaggcccaagggcattatatagtctaggttagtgttgtagatcatagataaagcaaaagtcatagattataaagggaatgttgaaattcctttaggatggtgcctttgcaccacttctctataactccaacataaccagttttccctctatagagttggaacagattatagtttagtagctcaccaaataaagtacgtagcttgtatttaccagctatggtatataaaaatatgaatcattaaatgctagtataaagcagttagtcttaaaaaaaaaaaaagatccacaaaagggatgagtgggagataagattgaagcaaaattatagaaagttgtataccaggctgagggctttctgtgtcacttcacaggaagtaggtaaacaccgaaatttagtcagtgtcattattagagttgtgctttcataaaaagaatctctcaagtgtgacaaggctaaattagaaagaagagactggaggtagaggccagttaggagatccttgtaataatccacagttgatggaatgaggatctagagtagccaggctggaggtaacaaagagggacaggagggcaggagtactctactttaaagtagaatgaataggaccaacaaatgacttaaagggatttaaagaaaggagacatt

SEQ ID NO: 84792 - DNA, 770 bp, Homo sapiens
ctttgatgaaatttggagttgttgccagttgaaggaagataaatattgtctggattctttgtggcgaatcatctaagtatggcaaaactgtgcattttctagacattccaaactttaagaataaaaaagaaagtaactcatattttaagtgacaatattatcagcctgaatatcctgatgtgtgggattagagcgataaaccttggaatgcaaagaaatattactaagaattctgtttttatggccacaaaaagtagcagtgtataatttcccctgtgatccattcggctgacatatacaaaaacctgagtatgctctaatggcttggaatccttcccctgctgttaccacaatttaaaagaatgaggactgctctccatttgttgcagcaatcaggaaagcctttgtcacatacccgaacttgggtggaggccggcctggcacacagagtgatcagtaagacgacctgtattaggctttcctccaggtataggggggatgagcagtggctgacactagtggccactgtctacctgaccagccactcaggaaggttctaccttgctttgcagaagtgggccaacccatgagccactggggaatgagagctgtgaaaattgagggttgaagcaaatcaactccctataggcatttaaaaaatagcagacatattatttcactataagccagggtgcccaggaaagttcagttcctttttgaatagcgggtaagtccagcacagaaagttcctctagagggcctagagctta

SEQ ID NO: 84793 - DNA, 441 bp, Homo sapiens
ttagaaagaatacaccacaggccgaaatagtttcatatgataggaaaatctttaaagaaaggaacacagagttattagattatggttggctgtataaatttagctgggcagcgggaggaaggtcataataaatgtatcctgctctctctcatcaattatcagcagcacatcccccaacattctctcctcccaaagactgaaggatgtgcagcaaagcttagatcttgaaggagaaggttcgggaaaaattaatgattttaattagaactttccaatctaagtagaatcattaccttaattagctaaataaggaagtatgaaggatgaaattttgcaaatgaaattttgtaaatgtatggtagcgtagaatacccccattgcttcattttaaaaaaagaaaatataaatgcattttaattaataaatgacttttcatcatgt

SEQ ID NO: 84794 - DNA, 448 bp, Homo sapiens
gaaccaacgtattccttttggtctttttaacaggaatgctggaaatatttgggcctaactgatctttagtcattatcctactggtcaatatgggtaggaattaatttggcccttgaaaatcagacagcggaaaaaatgcacctcatgatcattcagcctctgactttttgggaggaaatcattttcaaagaaatgtcccccaccaaaaaaaatctcttaatgctacactgcaaagggaaaataaaggcatatggaaatctgaatttttgttgtgtttctaaatttgtaatattgaataactttttagatgtgaaattaaagatgactcataagtcctacttctgactttggtagtaataatattcatttatgtactgtaaactattaggttcaaacataagctgtttctccaaagcctacaaaaaattaatgtggaacacctgatatt

SEQ ID NO: 84795 - DNA, 356 bp, Homo sapiens
actattccccactattccttctatatggttgcttactatggggtaggtatcatgtcgtaattatttttgtgtgactgtttcctagcactgtgttccacttaacagattgtcaataaatctctgaaccataactaattcctttcttttatccctaaacatcacatattttcaagaaatgactcttaatttctcctcaagtaaacttttattattgccctcactgcaaattcaaactttgcctaccagatgtcgaataaagcatgacaccaaattgcacaccctattaacatctcagtatgccttcaaattccattacactcaagtcccagtacagtggagcaaaatagctcctgtat

SEQ ID NO: 84796 - DNA, 315 bp, Homo sapiens
  misc_feature (314)..(315): n is a, c, g, or t
tgttcagtaagtagagaaacagttaaataaataagtgaataaataaatccacctaaggaaatattaaaaagtcattgaagacatttttacacagtgtagcattttttaaagtctgttacgcttaaacttttatccagactgctagatattgtctctcaggtgccaacagccatttcaaactcagagtccaagtctgagctttgcgcacttaggcacagttgcaaaacgtaaggtcctagtttttaatttaagagaagtctggtacccaaagctttgcttgtagagaccaagccctacacaaaaggaaattatcnn

SEQ ID NO: 84797 - DNA, 725 bp, Homo sapiens
cttgacacctactacccagaatttggaagtagaattttaaactgaggtcagccccttcactttcatagtttaagaaagttagtgccccaaaggggatcattttctgccagagatcacatggggatggagctgaatctaagacccaggttcccctgattctcactctaattccctaagctgccactgcaaagaaaaaaaaaatcaagttgggatctcattctgggggaaaaatctcataattcctcgttggagctatggaatagctttatattatataattttattcaaactgatatgagccaataaatatagattgtgtgtgtgtgtgttagctgttttaaaacattttaatgtttaaaacatgatttactaatgctgctggggatgtctagaatttgatttactgcatattattgagtgtttatacttgttccttacagaaattcttgccaaagagccattttatctacaggaataataaataagtcaatatgtggatggttgtgcacatttttcccatatgcagtgggacttggtagatgttactttgcacacaaacactcagaaggtaaactggagagatgcacatggatccctgaagtccaaggcttggccagtgtcaaaatcagaccattcatcttgacttaaaccaaaaacacggtcagcaagtctaggtcttaggtgatatttgggctttgggaataatggatctacatgttcccata

SEQ ID NO: 84798 - DNA, 543 bp, Homo sapiens
cggtatgggggtaacagtcaaccttatggggatactgggcaaaagattctggcggtcagcatataagagggtgctggtcattggtaacaatggacctttccccaaatcaggcagtatggagtgatgagtggtaaaatctattcccaggccagaatcttatcaatacataagaaattaaggaagattaggtgccaaaatacccagcacaatactggtatattttaagtaccatacagaagtaaaatcccaggaactatgaacactagaccttagggggttaatcccttcaatcatttcaaacatggacggtagggcctacagggttatggggcctggctcactttatgtctacatctcccacattcataccaatatacgtcgggttggctaaaccatggatttgctgggcttgggtaggagagagtctcactctgtcacccaggctggagtgcagtggcgccatctcagctcactgcaacctccacctcccaggttcaagtgattctccggcctcagcctcccgaatagctgggattacaggcc

SEQ ID NO: 84799 - DNA, 417 bp, Homo sapiens
tgtcaaatgttcctggtaagtcaaatcaggcaggactgcaaaccaacgcctggattaacaatgtgaagatcattggtgcccttgcaaattcagtgtcaggggaacttccttggagttggtttaaaggagaaactatgaacagcaatacagagacaaccatgcaagtagctttcctgtaaaggggagcaataaaaatgaactgtgggctgggtgtgatggctcacgcctgtaatcccagcactttgggaggccaaagcaggtggatcgcctgaggtcaggagtccgagaccagcctggccaacatggcgaaaccccatctctactgaaaatacaaaaattagctgggtgtggtggcgggtgcctgtaatcccagctactcagggggctgaggcaggagaatcgcttgaacccaggagg

SEQ ID NO: 84800 - DNA, 330 bp, Homo sapiens
aatttcataggttgtgtcttctgaaatctgtaccttcttactcataacatttaatgtagcatttctcaacctgaccaatctgcagaaaatatatgtcatatattaattgtgtatacatgaatatatgcatttttctggtaaaaagtcatagtttttcatagatgtcatgtaatcttttaagagattctcaaataggaacatgattccaccccaataatggtgaaaaatgatcaatttagatgaaagggacctcaacaagcctcttgagatatgaaacataaagagaaaatataagccgcaactttttgacatgacagattcataatgata

SEQ ID NO: 84801 - DNA, 1292 bp, Homo sapiens
catacattagcttacagttgggcaaaatcatctaatatgaagcctattttataacaaagtgttgaatatctcacataatttgttgaataccaaactggaagtgaaaaacagaatggtcgtatgggcacttgaagttccgtttctactgaatgcttatcactttcacaccatcataaagttgaaaaatcagggcctatcagggtcagctctggctgtcttttccttgagggtttctatccttagtatgggctcaggaagttcttccccatgccaatattatattggcaccttttaatggtttcagttttctcatttaattaatctccctagaatttgtttttttacttttttggtttttttttttttttttttaagatggagtcttgctctgtgtcccaggctggagtgcccaggcacgatctcggctcactgcaaactccgcctcctgggttcacaccattctcctgcctcagcctcccaagtagctgggactacaggtggctaattttttgtatttttagtagagacggggtttcaccgtgttagccaggatggtctcgatctcctgaccttgtgatccgcccgcctcggcctcccaaagtgctgggattacaggtgtgagccaccgtgcctggcctagaatttgttttgatagatattagattgagatgtaacatttctccccattatttgttgaatccttcattttctcactgatctcagactttatcaaatggaagcctgtgtctttgcactcgagttctttctgggcattctgctccattcctgtctgtccagcatcagtccactctctctcattagtggtgtcatatgagatagtcactgtttggtgaacacattccatcccttattctgcctccttttaaaaaagattctttgctattctcaagcatttaattcttccaagtaatcttctaagtcattggacaaattccttacaaaaacaccatggagatttcagttgaaattgcattaaatttttgtgttaacttacgggaagactaacatctggacaatgttttgcctgcccttgcttatgttgattcagatttttgatgtccagtgagaggcttggttggtgtatcaggctctgcacagggaagctgtccattctgtggagttgttggtaactggctggtcctggggacagagaactggccctcgttcctgactgttaagggaaggatgatggctcttggcttgaaaagatcatctttatcatgttaacacagtttccttctgtttctaagaggtattatcagaaataacac

SEQ ID NO: 84802 - DNA, 814 bp, Homo sapiens
tcggaagaagagtgttatgcctgtcacttttgaaattgagcttggatgatttctcctgattaatttatgtccctttagagaaagcaacgactgttgaggaagaataaacttttttttttttttgctacaattacaaaataagggatgtaatctaacttaagtattcagagcatagagccttgtatgaagtggacatccagtaaaatgtttgattaaatttgtagtgaatgtactgtgaaaagttgatcattggctttgggctttgggctttgagaactagatataggagtttatagctggaagactaagaaatctcctaaaacagtcccgttgatttatagaaaaggaggctggcatttctatttttattttcaggaaattcaaatttagaaaaataaaatgcttaaattaaccttaaaaacaactattttttagattacaaaagtcttgtagaatataaaaaaagatgagtttgtgtgtgtgtcccagcgtgaaagtctgtaattaattctactcccaggaattgatgcagcaaatatttatggagcctctactgtgtgctaggtagtgttctaggcactggggaagtattagcagacgaaacagttgaaatatttcttctcacagcactttattcctaatggaaagggaaataggcagtaaatatatgtgtcaggtggcggtaagtgctatgaagaaagatggaggagaactagagtggattttctattttatgtgggtccagggaagccctctgacagtgatcaggggagtaagagggtgagctgtcaggtactctggggaagcgggtaat

SEQ ID NO: 84803 - DNA, 804 bp, Homo sapiens
ggaggattgcttgagtacaacatgtagaggctgcagtgagctgtgattgtgccactgcaccccagtgtgggtgacagagcaagaccctgtctcaaaataataaaattaacattcattaacaataatgttaatatatatgttaatgtatatgttaatcgtaatgtttatattttaccatgataaaaacattttaaaatcatatatcaactcttgccgttctcctgttgaaaactctccaatgacttcccactccatcatcctgtgggatgggtccaccatgctggaccacaaggctctgcacaatgcggctcccaccagcctctccccttggcccagattgcttcctcctacccctttctctagctgccaggccccccaacccccgcatggagcccttcagcagctctgtgagctccctgcctgttggcagccatcacagcaacgggctctggtgtgccccttgttatccctgtattcaggccattatctgtaatgacagcctggcataattttattttcacaatttgtataattatattctattgagctaaatgatcattataatcattattaaatatttattaagcacttctagctgtgcaaacataataagatgtggcctcagctcttaaaatctttcttcctaattccaacccaaattcatttcaacttaaccaatcttccttcttggagaaggagggaacttcggcgttttgtctgggtttccatgcccgagcttataggagcttcttagcaatgctgtggagcagatgctattgacttcagtttacagataaggaaaca

SEQ ID NO: 84804 - DNA, 273 bp, Homo sapiens
gcatttcagctctccttcctttggagggtgggagggttgttgactatccttaaatgtcaacaggcctttcacattttaagcaaatcagtaacagttaaaaggactacagtgatttcctggagtgggtaatacataaaactcaggccaggcacaatggttcgtgcctgttaatcccagcactttaggaggctgaaatgggaggatgactcgagccccagagtttgaggctgcagggagctatgatcatgccactgcactctagcctgagcaaca

SEQ ID NO: 84805 - DNA, 286 bp, Homo sapiens
gcattttagtgctgatacagatacagtgagttcctgccctttcctctcctttatattgaagggattataaatgaagctctttaaacattctgagatctttaagttgatttctacatgaactccaagtggtgttaatgacattttcagaaaagatgctttacttagctgacaagaaaaagtactctgtaagcctttatttgtatgtgataaaacagagttgataaaataatctactattaacttatcaatgcagtcttacagaatccacctattacaaagtagataa

SEQ ID NO: 84806 - DNA, 779 bp, Homo sapiens
cgcaaagctcccctctacacctgagcgggggacagatgtgcatcaatatttattcggaactcccaggaaacctggatgaagtgtaattatctcagctcaatcagcttggattagcataacatcaagtcacccatcagacggagggtttgatttcggggatcaaagcgacggctgtagccgctgattaatcggggagaaggaagcggcgagaagaaagcggcgccggctctgctagccacagctgcaccgctttgaagcgccggtggtgccaagttaactttgccggccgcccccgccgctcctcggacccgctgcgcccgccgggtccgcgggttttagcgccgctccctgggctgcgagtcgccggctctaaaataaaccgtgccccctgcccacccggggctgtgttgggggactgtttttcctcggtctaggatctgctccgaggtggaggggcgctgcggggcttgcccggcccgggacctgggctggaagctcacgagaaaggacgctcctcggaggtgtgcactgaaggctgcctaaggctggagcggaggagtgaaatgatggagcgcaaggccttccccaagctggtctcagctggcgtttcctgcctcacctgccccatcccctcacaccacacacaaattacttattttcttaactcatcaggctttattggttctgtacctttgtacaatccgttttccccaattggggtgcacttctgtctccttctgttcccaaaccactctgacatccgtaataatcaaccctgg

SEQ ID NO: 84807 - DNA, 405 bp, Homo sapiens
gaaggtaacttggattggaatgattctcaaaaatgtaacagttgaattatggaaaatattaagcactttaattaaggaaacttattgatcaacttcaaactggttttggctttagcataataatttttatgttaaataaataataaattgttattgcatagtcgttatatatattagcttaatgaagatataaactttctcttattcaataataaaatgagaggtcaaaaaccaatccaatacctaagataaatcatttcacactgggaattgcattttcttcatatgtagaaaatgtttgaagaaaagcagtagctatggcataatgaaaacaccattggcctcagagcaaagacagctggcttgagggctgccacatttactttttaaataaagggataaatt

SEQ ID NO: 84808 - DNA, 220 bp, Homo sapiens
gtcaacgcaggatctactccatcatcatcttcactagcacacccagttcgattgaggagccttgacgtgggatattgatgggatattgagagaaaagagaaatggtgaatcaagcactaatctcaaagcttctgcacagaactacttacatgtcacttcctcccatgactattcctaaattcagccaaaaggggacacataatctcttacgggggagggc

SEQ ID NO: 84809 - DNA, 854 bp, Homo sapiens
cagaacccggtgaagatggatgttacaaggctaaagggattttgcagaagtgaggaaggttatggatcccaaggtggggagagcatcctggtttatccagatgggcccaatctaatcacatgagcccgtacaagtggaagactttctcaggctgggcacaggaggagccatgaggcagagggagtgacagtgaggtttgaagtgtgagaagtgctggatgacatgccactgcaggctttggaggtgaaggggggcccatgaggcagggcaagtgggcagcctctgaagctgacagcacacaagaagaggaggacctcagcctagggccacaggaaactggattctgccaacaacctgaccaagttcagaaatgtcttgaatcccagagcctccagaagagaacatagccctgcgttcaccatggtttcaacctgtgagactgagcagagagccagccgagtccttctgtgttggacctctgacctacagaaccatgaaaccaatcattcgtgttgttttaatctgctaaatgtgtggcaatgcagtaccacagcgataaaaccaatccacccaccaccaatggtcttatgattctaatagcttcaattaatcctataaactgacagccggtccctattccccattctgctgaatcccaaagcctcacgactttcttctgttaggcaactctgcttggctgtgttaaaaacacatctaaccctacatgttagaaactctgccagctgacaaaaccagaaaccttgagtcagtctggattctttcctctctgttttattcattgtgtaatctcaactccatcaggtcttggttgaaatgtcagcatctcaaatggg

SEQ ID NO: 84810 - DNA, 383 bp, Homo sapiens
tcctcaccccaccctcaccacattccctctcatgggagcatccttgcatagaattctgtgccttctgcctggaatgcttttccctctttctccaaagcaactcgtgttcttccttcagacctcaaattgcagaagacctcttagggaggaaccgtcctcacttgttccgtactaaggctagatctgttgcttttgccacatttactatttaatgtttgtttaagggatgatttgtctaagaatttgataagggttcagtaaaaacatagtgaacaggacttgggttcaagtcccaggtcttccatttacaagctatataatcttgagcaaattacttgaaaaacttcaactcagagaaattaagtaattagcttattcagtgg

SEQ ID NO: 84811 - DNA, 285 bp, Homo sapiens
gaggattaatagaatagatcaaagcagaatgcagtgtgttcatgtcataggttgacttctccaggaaaccgaccccaagtggaaggtttacatgcaggtggtttattagagagtgatgttgggaagaacacctgtaagggaagaagggagcctgggaagagcagagggagaaggtgaactctgattcacttgcaacagagtcctaggctgagtgcatgggatgctgtagagttgggatggaccttcagagatattccaaatagagaaagaattcactctcttttc

SEQ ID NO: 84812 - DNA, 118 bp, Homo sapiens
aaattaattggaagcttaatattacctctaggaaagagtgtgggaaatgaggaaaggcaaaaggtaatgtgttcatgtttgttctgttccataatccaagaaatagataaacacaggc

SEQ ID NO: 84813 - DNA, 378 bp, Homo sapiens
tttttcttaacctgaaaaatgtgtcttagaagtgcttttattcacacaggtcttactgcattctttcttgaacagctgcattaaatggatgcaccagtttttatttaaccactcagtggacatttacatttgttttcactcttttgccacagtcaataacccgtgcatgcatcattgggttcacgcacaagtaaatctggaggataaataagtggaaatggagttcctgggccaaaggatacatatatttaaaatgggatacaggctgggtgcagtggctcatgcttgtaatcccggtactttgggaagccatggcagcaggagttcgagaccagcctgggcaatatagaaagactccatctctacaaaaaattaaaa

SEQ ID NO: 84814 - DNA, 762 bp, Homo sapiens
gcccactcacacacatagagtagcatgttatggcacttacactaataaagccactgctatcaaagttctggacttgatttccagcagtattagctctgttttaccctcaagcttctgggttagtgggttattgctcaccaaagaagttctggttggaagaagaggtaagatatctccagagccgctgagaagaatgagtaaggtaaaactggtggcattcctgactgaatacccttcactcacaggaggcagtgtggaacagtgggaatgaggagtgctatgggactttgtatatctggtctggaagcctgtttctggtacgtacagctagggatttgtagaagacttcaggactccagatgactctgaaatacttagcaacagtagaagataactacataagaggagcttggaactttggctcaccatggggaagagcaccactgaaggctgactatatctgcactgaacttgatggagcaagaataaattttactctccactaacatctagggggttgtattttacagcaattgccaccatcatcaatatagctgatactgtgagacagaaggtaaagtctgaacaagtttatagcctcagtgcaagtagctgaagaacaaaaccactaactctgtgtgaagaaggatatcaaggttttttaaaaacaataaaaaatgatagtgttgtagacctagttacgcatcatataaaatcctcccatacctaccagcttatgtattcatcctgtctttgatcctg

SEQ ID NO: 84815 - DNA, 175 bp, Homo sapiens
ccgcgccagggggtcaaccaactccgacaccgctcggcgtcagctgggcgccaccaggcgcggacttcggagcgagggcaggtgcgcgggccggaagcctcgggcgctcacctggcacctacctggagctcacctggcgcccgggccccgcgccgccgccccccgcccagcccgc

SEQ ID NO: 84816 - DNA, 386 bp, Homo sapiens
cttacttcatcctcagaataatcctatgaaataaattctcttgttagccagattgagaaagacaaggtatggaaagataaagtaactttctcaaggtcattcagccaggatgctagagtcataatttccatccaattcaccttcaacctagagctcataggcttggctgtagcatgaggatctttgctttagcccaaagcttcttggttttttggttttttgttttgtttttttttttcagtgaaaacccaatgggagaaatacagaggaagatgttagtagttgtttatacttaagtatgaattggtttctgttccagagagtgcatcttattagcaggtaaaggaagagagcagaaagtttgaggggaaatataaggactgtgt

SEQ ID NO: 84817 - DNA, 316 bp, Homo sapiens
gtggcggtacaaggagagcaaagagagagatgagagaatgggtgaatgagagactgtgaggctaaagaacctgaagggaagaagaagaataatgtcatgtggaagaagaccatacaggagtgcattccagagggttctacacacttgctagaggagagctgaaattttagctccaaacctccaaatggctcaatcagaaatggaaataggaccagtcagaagattcagagtgctcaaaagactaaagcaaaccagctgcacaaaagacatatggatgtcctgagcctgaaattctccgtgtgggtactcatctctc

SEQ ID NO: 84818 - DNA, 317 bp, Homo sapiens
taaacaagggatgagtactgtaagcagagagatttcattgagttaagaagataggttggaggtaaggtagctgaaatttgcaaaacagagtactggagaggaaagagttatgccaagaaagggctccagaaatctgcacatgtgtcttactgagttttggcagaatagtaagctgtgtatacatgaagtgaatacaatgaggctgggctatgtacaaatgccgggaaatttgttttgttttgttgttgtttgagacagaatctcactctgtcgcccaggctggagtgcagtggcgtgatctcggctcactgcaacct

SEQ ID NO: 84819 - DNA, 534 bp, Homo sapiens
tttctttttttatttttctttttctttttttttctctgagacagagttttggtcttgtcacccaggctggagcgcaatggtgtgatcttggctcactgcaacctccacctcttgggttcaagcgattctcttgcctcagcctcctgagtagctggaattacaggcacttgcccccatgcccggctaattttttgtaattttagtggagatggggtttcgccatgttggacaggctggtcttgaactccttacctcaggtgatccacccttctcggcctcccaaagtgctgggattacaggtgtgagccaccgtgcccagcctttactttctttaatggtaaaatttgagaatcctaagttttaaattttgataaagtccaatttaccacatttttctctcatatttgtgcttttggtatcccaacaaatctttgccttctcccaagtcatggagattttttcctgttttcctctgaatattttagttttagtgtttatgtgtaaggccatgatccattgtgagttaatttctgt

SEQ ID NO: 84820 - DNA, 388 bp, Homo sapiens
gggccacctctgtggaaaccaaagagttctcaccaagcataaacatattcctgggctgatagaaattaaccactatttaaagtgtgtgagaagtgctgtgataattgagggacaggctggataagttctttatagacagagtggccctggagaggtgacatttgaagtgggacttgaggatgagaatgaggtagctgtgtcagggtctgggtgcctgcgtcccggccgcgagatagcatgtgcacaggccctgaggcaggaaagagcttgctgagttggaggaactcaggagacccctggctaagatgtgggggtggacaggactgggttgttggtagcggcagtggagagaagtgaatgtgtatgaggcagtttggaagcagtaaag

SEQ ID NO: 84821 - DNA, 1416 bp, Homo sapiens
cttcgctctcgctcggctccctctctagctgaccttccctttccctcacgcctccccacgcccggcccctggccccagcaccctgtccgctgccgcctcagagccgggaaaagcagccggagcccccgccgcccctgccgcagcgcgggcggtcagcgcgcagcccggcacccgcagcctgcagcctgcagcccgcagcccgcagcccggagccagatcgcgggctcagaccgaacccgactcgaccgccgcccccagccaggcgccatgctgccgcttctgctgggcctgctgggcccagcggcctgctgggccctgggcccgacccccggcccgggatcctctgagctgcgctcggccttctcggcggcacgcaccacccccctggagggcacgtcggagatggcggtgaccttcgacaaggtgtacgtgaacatcgggggcgacttcgatgtggccaccggccagtttcgctgccgcgtgcccggcgcctacttcttctccttcacggctggcaaggccccgcacaagagcctgtcggtgatgctggtgcgaaaccgcgacgaggtgcaggcgctggccttcgacgagcagcggcggccaggcgcgcggcgcgcagccagccagagcgccatgctgcagctcgactacggcgacacagtgtggctgcggctgcatggcgccccgcagtacgcgctaggcgcgcccggcgccaccttcagcggctacctagtctacgccgacgccgacgctgacgcgcctgcgcgcgggccgcccgcgccccccgagccgcgctcggccttctcggcggcgcgcacgcgcagcttggtgggctcggacgctggccccgggccgcggcaccaaccactcgccttcgacaccgagttcgtcaacattggcggcgacttcgacgcggcggccggcgtgttccgctgccgtctgcccggcgcctacttcttctccttcacgctgggcaagctgccgcgtaagacgctgtcggttaagctgatgaagaaccgcgacgaggtgcaggccatgatttacgacgacggcgcgtcgcggcgccgcgagatgcagagccagagcgtgatgctggccctgcggcgcggcgacgccgtctggctgctcagccacgaccacgacggctacggcgcctacagcaaccacggcaagtacatcaccttctccggcttcctggtgtaccccgacctcgcccccgccgccccgccgggcctcggggcctcggagctactgtgagccccgggccagagaagagcccgggagggccaggggcgtgcatgccaggccgggcccgaggctcgaaagtcccgcgcgagcgccacggcctccgggcgcgcctggactctgccaataaagcggaaagcgggcacgcgcagcgcccggcagcccaggccc

SEQ ID NO: 84822 - DNA, 446 bp, Homo sapiens
tgtaactgtttactgtcagtacctgtgttcgtacatgtaccccatgtgtctgtatgtatgcaggtatgcatctgtgtgagcgtgcctagctctgtgacatgggtaaagccctagcttgagtgctggtgaggaaatgaaggaaatggccacctggccctacctgggagggcctcaggctagagggaacacatagccccaaggtcaggaccctcagtgcctgagatgtggccttgcctgggagccccaggtagggggagtccacccaatcctcagagaatcaactcatgcactcaggaaatgactcaggaacagtgaaaagctccccaagaacaagttgaaagggatcttggtccttaatcatagcaaggatttggtaaccttggttacctgcaatgagtcaggaaaagactccaagggaagggagtgggggaggcattgtcacagga

SEQ ID NO: 84823 - DNA, 1738 bp, Homo sapiens
atcgtgagcaccgcagggtgctgtgtgattctgggcagataagggcaggtgtggtttacaactgctgttatgaactcagaagccctccccgcagcacttcctgggcagggcagcacagggcagctgggagcgcccagggggtgtaaaggaggagggtgaagggacatgggcacactttgcttccggagtctgcattcccgagtcagcttctatctcagcaagggccttggcagtcgctgcttttttctggacatcagttcttgattccttccatctccagccatggctggggccaggactcctttggagttggtgcttgaaggcagggagggctgtgtgaatgcctgaggcccgttcttcctgaacattcttggattctatttcccatgtagtctgggcacccaacagcttgttttctcgaggggctgcctgctttggggatggtgcccatgggtggcacattctccatcaactatgtttaagcatttcatcctgtgtgtgttgccctaaaaataaacatccctgtgggacgttcccttgcagtgtggctggtggctatgttctgagatgagagataaccactctttctgtccctctcttcccaccagggcgggagcagttccacggcctgggctccatgtactgccggggggcggccgccatcatcctcacctatgatgtgaatcaccggcagagcctggtggagctggaggaccggttcctgggcctgacagacacagccagcaaagactgcctcttcgccatcgtggggaacaaagtggacctcactgaggagggggccttggcgggccaggagaaggaagagtgcagtcccaatatggacgctggggaccgtgtctccccaagggcacctaagcaggtgcagctggaggatgcggtggccctttataaaaagatcctcaagtacaagatgctggatgagcaggatgtgccggccgctgagcaaatgtgctttgagaccagcgccaagaccggctacaatgtggacctcctgtttgagaccctctttgacctggtggtgccaatgatcttacagcagagagctgagaggccgtcacacacagtggatatatccagtcataagccacccaagaggaccagatctgggtgttgtgcctgactttcgagggcctcctggactcagactgtgcatgttgggaaggggtctgaccaggcaagctgtgatctgaaaggagcaaggaacagcaaggaattattttccagaatgacacccgcagcagaatgttggagtggaaatgatggctggctatgaagaggaggtcaacgtgtgtggtctcctcagtctctgtcagaggggtggggaggtgggaaacaggaatcctctgcaaagcccaatctgcagagtcgagacccctggtgctctctgccccgctgcctggcactggtcctttgcagccagccaccaacggcccccttgcccttgcagaggcagaagcctgcgtctgcacctgcacctctgaccgtttcagcaccctgggttgttaccacgtcctacaactctgacatttcttgttctcaagcgtttctcttcactgtgagttgtctttggtcctcccacttggtacttgtatcttgatgctttataatcctgactctcgacgtgttcatttatacaaaatcaggaataactttgtttttatactgattgcagcaatgttggctacatgtattattaaagaggatttttggaacaact

SEQ ID NO: 84824 - DNA, 1517 bp, Homo sapiens
cgtgggctccgtgctctgcacccagctccttcccgggcgcgcacacgcgcttcctctcttgagctcccgggcgtccggaggcgaaggtcccggagcgttcacgagaatccgggtcccggcgagtccggggtccgctcctccagctgcgcccagggcgcacgagccggccagcctcggggagagggcgcgggggcgctgggggttcttacgggaagatgaggaagcccgacagcaagatcgtgctcctgggggacatgaacgtggggaagacgtcgctgctgcagcggtatatggagcggcgcttcccggacacggtcagcacggtgggcggcgccttctacctgaagcagtggcgctcctacaacatctccatctgggacaccgcagggcgggagcagttccacggcctgggctccatgtactgccggggggcggccgccatcatcctcacctatgatgtgaatcaccggcagagcctggtggagctggaggaccggttcctgggcctgacagacacagccagcaaagactgcctcttcgccatcgtggggaacaaagtggacctcactgaggagggggccttggcgggccaggagaaggaagagtgcagtcccaatatggacgctggggaccgtgtctccccaagggcacctaagcaggtgcagctggaggatgcggtggccctttataaaaagatcctcaagtacaagatgctggatgagcaggatgtgccggccgctgagcaaatgtgctttgagaccagcgccaagaccggctacaatgtggacctcctgtttgagaccctctttgacctggtggtgccaatgatcttacagcagagagctgagaggccgtcacacacagtggatatatccagtcataagccacccaagaggaccagatctgggtgttgtgcctgactttcgagggcctcctggactcagactgtgcatgttgggaaggggtctgaccaggcaagctgtgatctgaaaggagcaaggaacagcaaggaattattttccagaatgacacccgcagcagaatgttggagtggaaatgatggctggctatgaagaggaggtcaacgtgtgtggtctcctcagtctctgtcagaggggtggggaggtgggaaacaggaatcctctgcaaagcccaatctgcagagtcgagacccctggtgctctctgccccgctgcctggcactggtcctttgcagccagccaccaacggcccccttgcccttgcagaggcagaagcctgcgtctgcacctgcacctctgaccgtttcagcaccctgggttgttaccacgtcctacaactctgacatttcttgttctcaagcgtttctcttcactgtgagttgtctttggtcctcccacttggtacttgtatcttgatgctttataatcctgactctcgacgtgttcatttatacaaaatcaggaataactttgtttttatactgattgcagcaatgttggctacatgtattattaaagaggatttttggaacaact

SEQ ID NO: 84825 - DNA, 934 bp, Homo sapiens
cgtgggctccgtgctctgcacccagctccttcccgggcgcgcacacgcgcttcctctcttgagctcccgggcgtccggaggcgaaggtcccggagcgttcacgagaatccgggtcccggcgagtccggggtccgctcctccagctgcgcccagggcgcacgagccggccagcctcggggagagggcgcgggggcgctgggggttcttacgggaagatgaggaagcccgacagcaagatcgtgctcctgggggacatgaacgtggggaagacgtcgctgctgcagcggtatatggagcggcgcttcccggacacggtcagcacggtgggcggcgccttctacctgaagcagtggcgctcctacaacatctccatctgggacaccgcagggcgggagcagttccacggcctgggctccatgtactgccggggggcggccgccatcatcctcacctatgatgtgaatcaccggcagagcctggtggagctggaggaccggttcctgggccgtcacacacagtggatatatccagtcataagccacccaagaggaccagatctgggtgttgtgcctgactttcgagggcctcctggactcagactgtgcatgttgggaaggggtctgaccaggcaagctgtgatctgaaaggagcaaggaacagcaaggaattattttccagaatgacacctgcacctctgaccgtttcagcaccctgggttgttaccacgtcctacaactctgacatttcttgttctcaagcgtttctcttcactgtgagttgtctttggtcctcccacttggtacttgtatcttgatgctttataatcctgactctcgacgtgttcatttatacaaaatcaggaataactttgtttttatactgattgcagcaatgttggctacatgtattattaaagaggatttttggaacaact

SEQ ID NO: 84826 - DNA, 576 bp, Homo sapiens
ttatttatttatttttttgagacggagtctccctctgtcgccaggctggagtgcagtggcacaatctcggctcactgcaacctccacctcccgaattcaagcaattctcctgcctcagcctcccaagtagctgggaccacaggcgtgcgccaccacacccagctaatgtttgtatttttagtaaagacagggtttcaccatgttggccaggatggtctcgatctcttgaccttgtgatccacctgccttggcctcccaaagtgctgggattacaggtgtgagccactgtgcccggccaagtcaatgagttttaataatgcttatttttccctatcttttgaagttaaaaagttggcttgctaaccagctataacttttagtatgttaaagtgttctggtctcactagcaaatcaaaaaggcccagcaatacgtcattctcccatatattctgcattgtctattaattttttacatgacttggggcacatcggccaggtgcagtggctcatgcctgcaatcccagcactttgggaggctgaggaaggaagattgcttgagcccaggagttggagact

SEQ ID NO: 84827 - DNA, 429 bp, Homo sapiens
aaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcc

SEQ ID NO: 84828 - DNA, 748 bp, Homo sapiens
gattatgaagatttgttttcttaaataagagttatagttttagcacttaacgtttggtcttttatgagttttaattaatttttgtacatgttgtgagtggaggtccaaattgattcttttatatgtgcttttccagctgtctcccagcacaatttgttgaaaatagaattctttctctactgaatggtcttgagacctttggagaaaatcaattaaccataagtatatgagtttatttctggaccctaaatttgattccattgagctatgtttctatgcttgtatgtattcataagtcagttggtagttcgtgtcttcctaggaatttgtctatttcatttaggttatctaatttgttggtatataattgctcatatgatttctttataaccccatttatttctgtaaagtcaatgtaatgtcctctctttcattactgattttagtaatttgagtcctcttttttctcttggtaagtctaaagttttgattttgttaattttgtttattttttttaaataaccaatttttgtgcttgttcattttctctattgtttttcttttctctatgtcatttatgtacactttacgctttattatttcctttattatgtttgctttgaatttagctttttcttttttctagtttattatatacttaggttattgatttgagatattttttttttttaatgtggatgtttccaatgaaaaattttcatctaaatactgcttttgttgtatccat

SEQ ID NO: 84829 - DNA, 459 bp, Homo sapiens
cgtgatatatgtgtgtatctactgtgtatggaggggagaggagagggagagagagagacaaaggtatggggagagactgtgaagtgacagaacacaaccagctctcctggaaatttaccctttcccaggtgttaggacaatgaaagaaacaaaatttccatttatcaaaagactttctgcattccaagtaatttcctagatgttttgtatcaattatcttattgaatttctattttcggatgtaagtattacaattccctcctagaggtgaagaaactgtggctcaggaagtttgaatgaccagattgggagggtagtgaatgagcccataatatttttcccattgccttggggcttaaactcaattaaataatggcctaattaaatagacatgatatacattatttaaataagtgtatagaccagaaaagcagggaagagacccaaagagtatgatat

SEQ ID NO: 84830 - DNA, 3102 bp, Homo sapiens
ccacctgccaggagcacgtcccgccggcagtcgcaggagccctgggagccgccgccatgggaatgtccaaatcacacagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagagttcaacaatgtggaattcacagtaaacaagcttgttacccactggcctttggggttcctgctgctctcatggctgtagccctgattgtgtttgtccttggcagtgggatgtacaagaagttcaagccacagggcaacatcatgggtaaagtggccaagtgcatcggttttgccatcaaaaatagatttaggcatcggagtaaggcatttcccaagagggagcactggctggactgggctaaagagaaatacgatgagcggctcatctcccaaattaagatggttacgagggtgatgttcctgtatattccactcccaatgttctgggccttgtttgaccagcagggctccaggtggacactgcaggcaacaactatgtccgggaaaatcggagctcttgaaattcagcccgatcagatgcagaccgtgaacgccatcctgatcgtgatcatggtcccgatcttcgatgctgtgctgtaccctctcattgcaaaatgtggcttcaatttcacctccttgaagaagatggcagttggcatggtcctggcctccatggcctttgtggtggctgccatcgtgcaggtggaaatcgataaaactcttccagtcttccccaaaggaaacgaagtccaaattaaagttttgaatataggaaacaataccatgaatatatctcttcctggagagatggtgacacttggcccaatgtctcaaacaaatgcatttatgacttttgatgtaaacaaactgacaaggataaacatttcttctcctggatcaccagtcactgctgtaactgacgacttcaagcagggccaacgccacacgcttctagtgtgggcccccaatcactaccaggtggtaaaggatggtcttaaccagaagccagaaaaaggggaaaatggaatcagatttgtaaatacttttaacgagctcatcaccatcacaatgagtgggaaagtttatgcaaacatcagcagctacaatgccagcacataccagttttttccttctggcataaaaggcttcacaataagctcaacagagattccgccacaatgtcaacctaatttcaatactttctaccttgaatttggtagtgcttatacctatatagtccaaaggaagaatgacagctgccctgaagtgaaggtgtttgaagatatttcagccaacacagttaacatggctctgcaaatcccgcagtattttcttctcacctgtggcgaagtggtcttctctgtcacgggattggaattctcatattctcaggctccttccaacatgaagtcggtgcttcaggcaggatggctgctgaccgtggctgttggcaacatcattgtgctcatcgtggcaggggcaggccagttcagcaaacagtgggccgagtacattctatttgccgcgttgcttctggtcgtctgtgtaatttttgccatcatggctcggttctatacttacatcaacccagcggagatcgaagctcaatttgatgaggatgaaaagaaaaacagactggaaaagagtaacccatatttcatgtcaggggccaattcacagaaacagatgtgaaggtcaggaggcaagtggaggatggactgggcccgcagatgccctgacctctgcccccaggtagcaggacactccattggatggcccctgatgaggaagacttcagaattgggaactaaaccatgaatgctattttcttttttctttttcttttcttttttttttttttttttttgagacagagttttgctcttgttgtccaggctggagtgcaatggcacgatctcagctcactgcaacctccgcctcccaggttcaagtaattctcctgcctcagcctcccgagtggctgggattagcggcatgcaccaccacgcccagctatttttgtatttttagtagagatggggtttcaccatgttaaccaggatggtctcgatctcttgacctggtgatctgcccacctcggcctgccaaagtgctgggattacaggcttgagctaccgcgcccggccgtgaacgctattttctaagcagccagcagtgaatctaaaactctggaagaagtcttctgtttgaaaggcttatttaagccacacgtacacacactgtcttagagtactgtgagcccaccccacattggtcatcttccctatcacacaaatgatgttattttggactagcttaattttgaaatggtaacaaagtttcctattccatactgttcatttctaatactcttacgaaaactattctaaaggaggcaggagccaaggccaaaagtgaacgtacaggtttgaaatggctgtgataaggaccagctggtattaactgataactttacctttgggtttttgttattttgtttttctagtccctacctgtgtttaaattatggataactcgaaagacagctcaggtgaaggccagtaatgatttttttgaagtttcaatggtgtgaaataaatttctgttctta

SEQ ID NO: 84831 - DNA, 1701 bp, Homo sapiens
  misc_feature (1119)..(1120): n is a, c, g, or t
cagtcaccggtaagttactgaatctgcgttggctgcctttcatgccactggtgctcctttgtggctatggaccagtggggggtgtatttcaatcctgtgcttgtttctttttgtcagagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagaggtaagagatacctgaaaggaacttctgttggtcttttttagtaaggccaagtccgtgtcttcttcgttttgttctgttcttcccttctgccctgttttctagctgtcagctacatgctgggatgcacgttggaatctggagtaagtgcttccttccctgtgagtttcacctcctttttgtcttatttaaatcccttatcccagtgaccactggagagtctaagccatccttagcatgggcatccatcttcctaaactgttattcatgcaaagtcatgctcgtggtaagaggtaagaggcaagagaggtgccttggaagccaagctggtggccgtagctgccattttagccttcaagctttgctccccagtgatatttctgtgacttagaagagttactgggcaaaattgtattgattttttgtttgttttgttttgtttttagaaggagtcttgctctgtcacccannctggaggcagtggcgtgatcttggctcactgcaacctccacctcctgggttcaagcaattctcctgcctcagcctcctgagtagctgggacaacaggcgcctgccaccatgcccggataatattttttgtatttttagtagagatgggatttcaccatgttagccaggatggtctcgatctcctgccctcgtgatctgcctgccttggcctcccaaagtgctgggattacaggtgtgagccaccacgcctggctaaggcaaagtttttttctttgctttcccatcatctcaagtatttccaaaagaactgctcagataaagagaatgggacagtgtcagtaactatcagaggtttgtgcttgctaatgctccatagagagtttgtgaatttcccatgtggaagggaatatgtggtgttactggtgacaaactaacaagaccatcctgtccacatttgaatcagattagattatgaaataaagatttcaggagaattgcttgaacctggtagacgggggttgcagtgagctgagatcgtgctgctgcactccagcctagcccacagagcaagactctgtctc

SEQ ID NO: 84832 - DNA, 781 bp, Homo sapiens
tgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtg

SEQ ID NO: 84833 - DNA, 573 bp, Homo sapiens
aaggctagtacgaggcccggtgtgtaatcggcaccgagggagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtg

SEQ ID NO: 84834 - DNA, 814 bp, Homo sapiens
tgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtgaagtgactcgtggaaatgtccacgggtaccgag

SEQ ID NO: 84835 - DNA, 1146 bp, Homo sapiens
tgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtgaaaaaaaaaaaaaaaaaaaaaaaaaaaaaaaaaaaaaaaaaaaaaaaaaaaaaaaaaaaaaaaaaaaaaaaaaaaaaaaaaaaccgtcgcggcgcggccgccccaaggaggggggcgccacacatataagtgcgcgcgggggacgactgctccccgcagaagttattatcaccgcgcgccgcgacgaagagaagagatgacacgccgcggcggtgtgtttataatagaggggcggccgcccaccaaagaatagtgccgctgcggctcacccggggtagaatagaaccacgtcggtgtcactcgcggggcagacgatgatactttgtgtctcccccgcggggggcgaactgttggttcccccccag

SEQ ID NO: 84836 - DNA, 1275 bp, Homo sapiens
tgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtgaacacaaacacaacacaaacacaacaacgaacacaaacacccacacacacaagaaaaataaaacccacccacacacgcgcacacagcacgacaggcagggaggcgaccgcaacatcagacgcaacgcgcacacaaggcagaacagcacgagagcggaggacgcgagagaacggaggcacacgcgcgaaggccgcggacaaaaaagagaggacaagagaggagcgcagcacagaggggaagacacatgacaagaggagccagagcagagaaaggaagtggagaaacgaagagaacaagacagaacagacagacgcgagagaggagacagcgcggagaagtaggaagaccgaccgcacgccggacgccgagcagacagaagcagaacagacaggcagctatcgcagagagggaaacacgacaaacaggtgagatgaagcagaacagaaacgaggtagaatgaccaccagcagagaggacaacgagggaagtaaacc

SEQ ID NO: 84837 - DNA, 1064 bp, Homo sapiens
gccctcccatgggcccgggctcagcgtcagtgcccgcctgtgcccctggcctacccccagcccgccaaggctcgggccctcagggccagcgggaggagtgaacgagccctcttgcagctcagccgctctggcctggcatgttgggagtgatgaatggcaggttccaggcaggcagagagggagggtgcgagggcagggcgtacgccgtcactgctgtctctgcgtcaagaccttggggaggccttgtccctccccagctcccactggaactggtcagaggttgcaggtgggttgaggtcttgactgtagcccagctcaggctggaactgctccctgtccccaagccagcctccctgtctctcttcaaagagtgtgagtccctttaggtcctggtgtgtggggacacacctccttcctcctctggcccggaggcttcggagcaggagagcctggagaagtgggggcactgtcggggctcctcggtacacagaccacgggacagatgcgtggcctggccctggcatccatgggcaaaggagagactgagacacaccgatgtgtcaccatggcccggtgcccagccttgccccagccccagctgggggcagcacggtgtcctcgcagggggaagtcagtgtggggcgggatgaggacccacagcctgggttcctgctgggaagcaacctggactccggcctccctctgtgcatcagtttccacatctccagagtctagggccctcttcctgagtgacttaatccctgaagagagtgtcctgtcaggggtctcagtctggctcccagggtgggcaccggccagggcgtggagcgtcttggtccggccgagccccacccgggcctgacatcacctccccactcccacagcgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtg

SEQ ID NO: 84838 - DNA, 1123 bp, Homo sapiens
  misc_feature (607)..(607): n is a, c, g, or t
tgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcagtgagntggcccctccccacccccaccctcctcccagcctggcagaatgacccctgacctctgctcatcctccaccctctctgttccatcccggacaagaagtaaagcagccttcttgaacaccagccatttcagtcatagcgacagctgctgctgctgcttaagcacctactgtggccctccctgacctgccctgtcccctccccaccctcccctcctcactctgctccagcctggaccacagagcaaaactctgtctcaaacaatagtaatacacattacattagctggcgaacaaaaacaaagacaagcatcacagaaacctcgacgggcatcactagttgcggggcggcaccaacagctcatggaacggcccctgtccatccgagcgtccgagcccgctcgtgagaagcggcaacacgcggcccccaaaagaagcgctaatggcacacccgggcccccatacacagagagaacaacgtggacgggggagaccgtcgcgcacagtcggcggcgcaacaa

SEQ ID NO: 84839 - DNA, 545 bp, Homo sapiens
  misc_feature (512)..(512): n is a, c, g, or t
cggacgcgtgggtcgacggacgcgtgggtcgacccacgcgtccggggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtggtngttgaaaacacaatcgaaaaaaactttaacacc

SEQ ID NO: 84840 - DNA, 388 bp, Homo sapiens
ctccatccagacactggcagtgagcgcccaagaggctcctgctgtgcccgtctcgaggcccttgctcttcccgtctaccccgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtg

SEQ ID NO: 84841 - DNA, 301 bp, Homo sapiens
gctgatgcaggtggtgaggccaaacacggccccgacagcagctgcagtgaacgtgtattgtccaaccttagccactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtg

SEQ ID NO: 84842 - DNA, 884 bp, Homo sapiens
tgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtgcaccacacccaccacccccaggggggggccgggtacccaatttggcctataatgaggccgcattacctcactggccccgttttcacaggccagctggggcccg

SEQ ID NO: 84843 - DNA, 830 bp, Homo sapiens
tgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtgaaaatacacctccacatcaggactaaaagctgtgcaaaaacgcgggcgg

SEQ ID NO: 84844 - DNA, 901 bp, Homo sapiens
tgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggtagggactgaaggttggagaagcatattaactgctccagggtcatttgaagctgggctgcaagtccaggtcggctgacctgctcctaggggtctctgaagcaaggaatgttcccatcaggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtg

SEQ ID NO: 84845 - DNA, 642 bp, Homo sapiens
tgggactagcgaaatctgtctgcactgatcgcagtcgtcctcagtttcaccctctaggaatcggcctgggggtgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagcgcccatgtccgcgagaagcccgacgaccccctgaactacttcctcggtggctgcgccggaggcctgactctgggagcacgcagtgagtggccccactcaccgagcacgaaaagacaacaaaggagagcagaatgagcaaagaaaacgcagaaaagaaaagaca

SEQ ID NO: 84846 - DNA, 115 bp, Homo sapiens
aggtgtttgcaaaacccaaggtgtgagccctgtgcctgccgggacctccagcctgcagaatgcgtccagaaataaattctgtgtctgtgtgtgtgtgtcagtgtccggagggctt

SEQ ID NO: 84847 - DNA, 421 bp, Homo sapiens
acagcctccctcctctgtctcgcaggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtg

SEQ ID NO: 84848 - DNA, 1126 bp, Homo sapiens
ccaggccgtgccatccccggggaggtacagaaaaaagtaacaaaaataatttttggcttcaagcacccaacaatggaaatgctgaaacccatgtcctttaagtccttttcttctcctagcagagggccctctgcctacatggggcaccgtggtggccatttaatgtactcctgcttggtacccacctctgctctgccccctggtggccacagacaccattgctgctgcctcagcacagtttgaccttgttgctgccaagagccacctctcctctcatcactgtccccactctcctgccatgcctcaggtggctgctggcagaagagcagtgggctttgtttcttcagaacatcacagcaaccactgtcttatcagctcacaccctcaggatcttactgccccttttcccaaaaatctccactccggcaaccctggccctgcatcattgaaggacatttaagtgatataacatattgttgcctcaaaaaagttttttccctcttcaacagctgggacaactggataaccacatgcaagagaatgatgtttggccactaaccacaccatacatacaaattaactcaaaatgaatcaaagacttaaatgtaagagctaaaacttagaacaaacaggagaaaatcttcacaaccatggatttggcaatggattcttagataagatgccaaaagcacaagcaacacatggaaaaaaagagatacattagacttcatcaaaattaaaaactcttttgtgcatctaaggacactatcaagaaaataaaaagaaaaactacagaatgggagaaaacatttacaaaccatatacgaaaggatctaatatccagaatatttaagaagtctatgactccccaacaaaaagacaacccaatttaaaaatggccaaaggactcgaattgatatttttccaagaagatacgcaaatgaccaacacacacttgaaaagatgcccagagctggacatggtggtatgttcctgtggtcccagttactcaggagctgaggcaggaggatcacttgagcctaggagttcaagcctggagtaaactatgatctcaccactacattccagcctgagcaacacacggagacctggtctcaaaaaaaaa

SEQ ID NO: 84849 - DNA, 875 bp, Homo sapiens
cttgccgaggactttgtccaccaagtgatgaaagcatgcaaatgcctccgaatcaaagatgaggaaaacaaaagctcagaaactatcttggagtcagcaagtaagaaggagcttagaaaggcttaacattttccatgcttctgcctggcttcagagcccatgcactctgccttaccacggcaggtgaaagatggccccaaattcttaggtacatctcctgccaaaagacccctcctatgggttctgtgactacttcaatgaaaagaatagggcagaagagatgatgagaacttaacatctggcagtgtccatttcctgtcttttgaaactttctgttaaaggcctgagccacgtatgaagtgtgaatcttcacaccatgcaagagaagccacatgttattgctctggtcaacaatcccagctgacccaaccagatagtgtatcaggcatatgagtaaagcattcttagattcttcagtccagcccttcaccagcagaacaccattcagcaacccttgtcggcatcatgtgggacagaagaaccacccagctgagccttatccaaattcctgaccacaaaatcataagagagaatgacttctttcatatcgctgaatggagcaacatgtttggccaagttcctgtcccagggaggagaaccttcagcttgcaacaagtcctggccgttggagaaaccatgagactagaccttgtgtaaagcagctgattctgccatgggggaaatgcccttttgtttactgagcttctcccacccatgccttgctccactttcctctagaagcctgagatattgggaataagagtctcagcctccaagagatggagaacatatcaagagagtctggatttctgggg

SEQ ID NO: 84850 - DNA, 404 bp, Homo sapiens
gtccgacttgcttccaccatgcgtcacctccctcgggcctggacctggcctgcacatgcccttcctaatctgtctccatctctcctcgctctccccttccattccccccaccccctcccacccactggaccctctggactggcatcagcaaagacctgttaaccagccccactttcttgctctaactgaaaccaggctccccgctgaggacaccactcctaatccaacacgcccctcctaagcccttcaccctcaggctccagggctgctggtgcttgcctccaagctcgctccttcctaccgcaaacctcccaggcctttagaagccaatctcctgcttttacccctccacgcagcaggacgttggcaccctactctcctcactcctggcaaggtgagacccg

SEQ ID NO: 84851 - DNA, 352 bp, Homo sapiens
cctgatgcagtggctcacacctgtaatcccagcagtttgggaggccgaggctggtggatcccttgagctcaggagttcgaaaccagcctggccaacatggtgaaacccccgtcttattagatgggagcacagagtggagatagggagaccagtgaattctccctatctccactctggaaaaaaggaagtcatcttgcctgtgacagttgtccaggcaagagatgctgggggcttggaccacaacagactatggactggaggagaggtgaagttttcaagagacatttaggaagtaacaccaccaatagtttagagagaaagaagaaggcagacgtgacagattttagacctg

SEQ ID NO: 84852 - DNA, 433 bp, Homo sapiens
gttattttttaaagtcgttttagtgattctgggtctttgcattttagaattagcctggcaatttccacaagaaagccttttgggattgttattggtattcttttgccgtgaagatctgtttggaaagaattgatcaagtcttctgatgcatgaatgtagtatctctccatttattttagatctgtaatttctttcagctgagttttgtagttttcagttgacatgtctttcccatcttttgtcagattattccgtttcatatttcttgacgttattgtaaatggtatcattacataaatgtaattttttaaaatttaaattcacaattgtttgttgccagcatatagaaatacggttgatttttaaaaaattgtttaattgtggtaaaatacacatagcaaagaagttaccatcttaaccattcttaagtgta

SEQ ID NO: 84853 - DNA, 881 bp, Homo sapiens
acaccagaaactgccccaagtgagaagcatgttttgaagggcagggcaggggaagcagacttttcttcaaaaatgtcaatgtcataaaaaatacgagctgtgtaaatatcccagaaaagtttagaaagacttggtacctaaagccaatacccaatcctagactggattctgttctagaaaggaattactaaaaagaacattagatcaactaacaaaactagaatatggagggcagattagacataaatactaaatcaatgttaaatttactcaagttaacaatatactttggttatgtaacaaaatatatccctattaggaaatatacactgtaatacttaagggtaaagggtggtgatgtatacaacttagtcttaaatggttcggaaaaaaataaatactgtgtatgtatagaaagagcatgcaaatgatgatgcaaatagcataaagtgttaacagtaggtaatctggaaaaaggatatatgagtggccctttgtattattatccttgcaattttttataagtttgaaattatttccaaacaaaatagtttaaaaagacaggagctagcttgaaggggattctactgggcaaattttggacaatttcaacaccaaaatgaatcatgactggaatggactataatacattgacttcagaataagaaacaatcagtccagctgatgcttaaaaaaaaatcagtttctaagagaagaaaagctcttctttccaaaagccaaataacaattacagaaagtgaaagaaatagaaaatcaccatttatatccaatataataactaaagtaagactcagccctgtgtactaaaaccactgagtgaaaggtaaggaatgagatattcacatagtattagatttctc

SEQ ID NO: 84854 - DNA, 862 bp, Homo sapiens
aattaaaaacaatttaatactcaacagtgggggaagggaatgttaagtaaatcaaggtaaatctacctgatgaaacatcattatgatcaccgtgaatgctacatagcaacagcagaaaattcaaggacacaatgttaacatcaggttctagtgaccctgagtgcaataatgtgaaaagcatccctgtatatgaatagtgtctgaatagggaattagtaaaaataattcctgtcattgtatttgggttggaggtttctttaagaatttgtttctccgctatccaaactgtgtgtggttatcttgtctttttcatttttttttttaagacaggatatcactgtcacccaggctggattgcagcggtgtcaccatggctcactgcagcctcaacctcctgggctcaggtcatcctctcacctcagcctcccaagtagctgggactacagcatgcaccaccatgcccggctaattttttgtatttctgttagagacaggttttgccatattgcccaggctggtcttgaactcctgggctcaagcaatctgcccatcttggtctcccaaagtgctgggattataggagtaaaccaccgtgcctggccttttctttcttcagagttacccaactgcttcattttttagaaatacagaaatgttgggaaaagacagaataatccaatatttaatattctgctcccagtatgcattaaataaataaaacaaaattcaaaaatggagggaacacaagtaattttcttttttgggtagagcagacactttggtcataaagagatctgtagtacccaagtctctcacacaaagttaactgcaactttcccaacaattccacttttgaaatcac

SEQ ID NO: 84855 - DNA, 449 bp, Homo sapiens
gatgctgtgtctcctgcatagagcggtatctactatcagtatttctgcatgtatcttatacatcatgatcatgttagattctaaggacctttgtctccttcatagtggattaaaagcatgatgtcattcactatttgtagttaattgaataaaaatatgtgtcaggattaactaaaggcattcctaaggaaatgtcaagcctagatgccaagtctgatctgtaatcttgtccaccatcttttcaataataaattcaaccataacaaatctccctttcattttaacaaactatgcagataccaagtttaggggtaggttttctggttacttttattttttctagagttggtcttttggcttagtcttgtacttttctaggggatttgttattctgctgggcagaattaagaaaaaactgaaatttatcaaaaataaatgtctttgataag

SEQ ID NO: 84856 - DNA, 264 bp, Homo sapiens
gagccatacagaaggtgctgggaaaactgctagagcctgaaccccacctacacctcccagaagggtctgggggaccccagagtgtgaagggcctggttttcccccagggcccaggtctgaccccaagttgggaggaccagaaaatgcaaaaggctggaatatgcaataaacagccccagacttggtgggagtccagaggtctaggtttcatcactcaccatgaggccctgggccattcacttccccaccacacctgcatcctcc

SEQ ID NO: 84857 - DNA, 1893 bp, Homo sapiens
  misc_feature (2)..(2): n is a, c, g, or t
  misc_feature (4)..(4): n is a, c, g, or t
ananagagagagatagagaaagagaaagacagaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagagtctaccagccagatgcacacagcatcatctttggagaagcaaataggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaata

SEQ ID NO: 84858 - DNA, 1847 bp, Homo sapiens
  misc_feature (2)..(2): n is a, c, g, or t
  misc_feature (4)..(4): n is a, c, g, or t
ananagagagagatagagaaagagaaagacagaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagaggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaata

SEQ ID NO: 84859 - DNA, 1423 bp, Homo sapiens
gttgcattaaacttagttcttgtctctcctttccactcttattcttaaatctgaagctcatcgactaagtgaaatatttaaagaatatgataggccagcaagaagaagtattatgtagtaccatagttagtaaattcgtaaaaccttggaagccattatttggtcccacttgcaatttagtgtttttgaagtgtgtagcttcattcagatagctctttaaataattaaaatataaaagcaaacaacccaaactacctgactataaacaggaaaagttaaccctcaaagagagttcttgtgaattctctttatgctggcaaatagctctaggattaaaggcacattagggtttccttcagtttgtttattctaagcttttactgtgctttttactgaacaagtttctgatgtataaaacttgcatctgatttctttggaaatattttcacaaaagttattttaatcagtatttttacattgcctttccagtgtccagaagtgtttctaaacttagaaagtgacctatagttttttaaaattatgttttcctagaacgtgccaaattttgatttactctaacaatcagtacttttcttcagatgctttgttctgtttagaacaaaaatgcactatagtttttaaagaatcatgcatctttgggttggcccaggatcaaatttgatattgaataatttattccagggcagctttcataaacatacttcatagatgttgttttgaaatgtttctaaatatctaaaatcatttcaacagcagaaatgatttttattttaacaaaagattatgatagcccttgtagtgtttaaaagtggtcatatttattactgactttgagtcaggtgttaaaatagcagtgccacagctcgtctcttgccttagtgtgctgctgtgagagtcacagtggaaactgcagggaggaggtgtgttcctaagaaccaaaatccagcacagcatcctgtgaagccacgtgtaatgatggtcccataaggaaagtatgtgaatatggctcttgtaaaggattaactattgtaattttagcttatgctctgtattctgttttctatggaattatttaagcccttttagtgacctttgtcctggcccatttaaaaactaaaatgtagtatatattgtataaaatggaaatatcattattgcttcattaggggaaactgtacataggcattgaaagaagggtaaaagcaagcagttttatcaggcagttgtaaaacaccaaaaatatagattcgtctttgacgtgtaacacactaaatgtattttgtacagcatctggtttaaaaggtgccttaagagtttaccattacttgctttgttctatatacagattatgtccaatgtatcattttgaagtaaataaccttattttagtataaaaaaaaac

SEQ ID NO: 84860 - DNA, 1432 bp, Homo sapiens
gttgcattaaacttagttcttgtctctcctttccactcttattcttaaatctgaagctcatcgactaagtgaaatatttaaagaatatgataggccagcaagaagaagtattatgtagtaccatagttagtaaattcgtaaaaccttggaagccattatttggtcccacttgcaatttagtgtttttgaagtgtgtagcttcattcagatagctctttaaataattaaaatataaaagcaaacaacccaaactacctgactataaacaggaaaagttaaccctcaaagagagttcttgtgaattctctttatgctggcaaatagctctaggattaaaggcacattagggtttccttcagtttgtttattctaagcttttactgtgctttttactgaacaagtttctgatgtataaaacttgcatctgatttctttggaaatattttcacaaaagttattttaatcagtatttttacattgcctttccagtgtccagaagtgtttctaaacttagaaagtgacctatagttttttaaaattatgttttcctagaacgtgccaaattttgatttactctaacaatcagtacttttcttcagatgctttgttctgtttagaacaaaaatgcactatagtttttaaagaatcatgcatctttgggttggcccaggatcaaatttgatattgaataatttattccagggcagctttcataaacatacttcatagatgttgttttgaaatgtttctaaatatctaaaatcatttcaacagcagaaatgatttttattttaacaaaagattatgatagcccttgtagtgtttaaaagtggtcatatttattactgactttgagtcaggtgttaaaatagcagtgccacagctcgtctcttgccttagtgtgctgctgtgagagtcacagtggaaactgcagggaggaggtgtgttcctaagaaccaaaatccagcacagcatcctgtgaagccacgtgtaatgatggtcccataaggaaagtatgtgaatatggcaccccccccccccccccaacaacaactaaaacaccacccatatgaattctgtattctgttttctatggaattatttaagcccttttagtgacctttgtcctggcccatttaaaaactaaaatgtagtatatattgtataaaatggaaatatcattattgcttcattaggggaaactgtacataggcattgaaagaagggtaaaagcaagcagttttatcaggcagttgtaaaacaccaaaaatatagattcgtctttgacgtgtaacacactaaatgtattttgtacagcatctggtttaaaaggtgccttaagagtttaccattacttgctttgttctatatacagattatgtccaatgtatcattttgaagtaaataaccttattttagtataaaaaaaaac

SEQ ID NO: 84861 - DNA, 221 bp, Homo sapiens
aaacagtgtagtgatatatattcccatttataaagtttaagactaattttagttgactgtaaatattattttcttagatttttggtgtatggctttcaggataacacaaggtgaaatgctgattgaaatgttaagaatgtggagttgatcacaacttgagttttaacatttgtttttattttgtgcattagatttgctttttcttgcatttcttatttctg

SEQ ID NO: 84862 - DNA, 522 bp, Homo sapiens
catagtaagaaccttagaaaaaaaagctgaacattgtgtatgcatttgactctagggcaaatatatttttttgagggggaaaaggccttaacttctacttgtgtatgcacatttacatgtgttttctcaatcatctgaggcactatccctacttgacaggtgaccaaggtggggctgaagagactgacatatccaagtggtagaggggctgggattggacctcccagccacaaagctgcactgcttttcagaaaaaggtttcataacccaagcactgggctgcaagacttggaagggcagacacctggctatactcatctgggagtcctgctgctcaataccaagcctgactcagagcagcgttatgtccagcatgtttatccagtgtatggaaaaggctgttgtatccatccttgctttctatacgtttgcactatttcaaaattaaaatattagcatgaagatccaaccactgcagcccaacatcagtgctctcagcactttgcccctcaaattgggccc

SEQ ID NO: 84863 - DNA, 502 bp, Homo sapiens
ggtggtgtttgtaggtgtgtgtatatgcgtgtgtgtgcatatatgggggggacatgtctgtaaacgagtacctgtgtgtataaacataggtacctgtgtgcggcgtgaatgtgtgcctgagtctgtgtgagtgtgcatgagcatgtgtgtgcacacacttctctctgtgtgtgtgtgtgtttggggtaacatggtacacagtgtgagctcatggagaacagtggttcagccaaggatttgggtacccggcccgacagcacccacggctgccaggggagcctccagacccacgccaagggccccaggaagccgagcactcacaggcggggctgcctttgcaccagcacagctcccagctcactactgccagtgacttgttcaagctcaagtctgtcctagaaataaagcctcacgcaggtttcaaagtcgcttgcagtgataaaatgaaactaagttgtttatatttttaatttaaaaatgtcacaattaacatgaactcatt

SEQ ID NO: 84864 - DNA, 304 bp, Homo sapiens
taaaatttgccctatttaagctgaagcctggataaactgctgagccagattattcctgtgattggagtttaattgctgtagaacacttgttgagaacacattttttactttttttctttcagaattattcctcaatcattgttctctaatgaaaacaccgagaagtaaatctggtgcttcttagtgtaaatatgtttttctttttaaaaagtcattttaaaacaaagatgagagaactataaagtaaggggaaatatcattttatttaaaaataattattcaatgatagataatggagatacag

SEQ ID NO: 84865 - DNA, 362 bp, Homo sapiens
gtgaaaccccacctctacaaaaaatgcaaacattagctgggcatggtggcacatccctgtagttccagatactccggaggttgaagtaggaggatgacctcagcccagggagtcaaagctgcaacaagctgtaatcatgccactgcactcccacttgggtgacagagtgagaccctgtctcaaaaaataataataaaaaaaaaaaattagctggacatggtggcatgaacctattggtcccagctactcaaaaggctgaggtgggaggatcacttgagctcaggaggcagaggagattgcagtgagccaagatcacaccgccatactccagcctgggcaacacagtgcctcaaaaaaaaaaa

SEQ ID NO: 84866 - DNA, 236 bp, Homo sapiens
  misc_feature (173)..(173): n is a, c, g, or t
  misc_feature (231)..(231): n is a, c, g, or t
  misc_feature (233)..(233): n is a, c, g, or t
  misc_feature (235)..(236): n is a, c, g, or t
aattaagggtcctattaaccctcgactctgagacaaaggcacgaatcttctgagacgagatgtctgccaaacatctgccagggaaaataaaagtagtaaacatgtcagtggctgcgaggggtctgaaggggccgcgatgatctgaagtgcggccttgatgtgcaccgggcctnccaaggccggttatatggcttacgttttgatctgaggagctcttgctttgcttcctgngncnn

SEQ ID NO: 84867 - DNA, 515 bp, Homo sapiens
gttatttcagcttaagagctgaaagcaggattaaaaaaaaacaaccaacggcatggttattagcattgctccataactgccctttttccgccccactcttttccccattctctctctacctctccttctctcctcatactacatttccacttctttgtctcttctctcttttttcataccttgcctacatcacaggtccacccatgatatcatctgaactgccccataccacagaggcagagtgtggtggctcacgcctgtaatcccagcacactgggagatagaggtgggcggactgcttgagcccaggagttggacaccagcctaggcaacacagtgagaccccagctctacaaaaaatacaaaagttagccaggcatggttccctgcctgtggtcccagctacttgggaggctgagacaggaggaatgcttgagcccaggaggttgagaccacagtaagccaggatcgtgccactgcactccagccctggtgacagagtgagactctgcctc

SEQ ID NO: 84868 - DNA, 506 bp, Homo sapiens
tcatctgtattatttcactgtaataaaccgtaagtgtggcaggtactgagtcctgtgagcccttccagcaaaccactgggcctgagggtggtcttggggggtcccaacataccagcaaaatgtgctgctctcacttaatgagatcacatcaaagcatgagacattactgttttgcagagtttcagggtactttcatcctctactaatgtggacattttattcaggtcttccttattttattatttgatgaaactaatgttttcctttattattcctaaagcaaagactgccaacacctcaaagaaatgctggccttcactgtttcataaagattctttttttaaacatggatacacattagcaatgtaaaagagccgctgcagtcaaaaaatatttttagagactcagctgaacaataagccctgaacttttgtttaaattaagatagctgaaccattaaaatgatttcctgaatccatggaaacgtgtcttgcataagaaggcat

SEQ ID NO: 84869 - DNA, 441 bp, Homo sapiens
aaatacaaaaataacaataagaataatacaaaaaaatttaaaatgtagtataacaactatttacatgtcatttacattaggtattacaagtagtctagaaatgacttcaagtatagggaaggatgtgcataggttatatgcaaacatgatgctccttgtcttatgatggatttacctttcgatattttctgtttacgatgggtttatccagatgtagtcctgtcataaagagcatattgaatgcgtgtatcaccatcctaaagtcaaaaaattgcaagttgaacaatcaaaagttggggactttctgtactacaccattttatgtaagggacttgaacatccacagatttttgtatcctcaggagtcttaggaccaatcccctgtggataccaagggacaactgtatatcctttgaaattttaacttaatagattttctac

SEQ ID NO: 84870 - DNA, 401 bp, Homo sapiens
ctcggctcactgcaacctttggattctaagcaattctcatgcctcagcctcccaagtagctgggactacaggcacgcgccaccatgcccagctaattttgtatttttagtagagatggggttcaccacattggccaggctggtctcgaactcctgacctcaggtgatccacccgtctcggcctcccaaagtgctgggattacaggcgtgagccaccacacctggcctgtccctttcctttgttgattcactgtgcagaagcttgttaacttgatgtaatcccatttgttcattttagctttggttgcctatgttggtgtggtattattcaagaaactttttcctagactagtgtcttggaaagtatttctggtgttttcttgtagtagtttcatagtttaa

SEQ ID NO: 84871 - DNA, 623 bp, Homo sapiens
catgtgtgtccttgtgcattttgggtggacaaactagatgagaacaggtgggtgggggtggaggctaaaggcagaggaagccaaagacagtgcctccagtagcccgtgggaagcttcctcatgcctttgagatattgcaggaggtcccagagctctggcccatggtgatctcagtggtactggattctgtcttaaagatttgggcagttctgggggtgacacaattagggaatatgactcacatcaaactgaccatgaaataccagttgagaaaggaaaagtaagaagagaaagatagttttgcaaatgagtcaaggttacatagatggaaggaagagctagcctggatttaaacagatcttcatggtttcacagtgaacttcaaaattactcttttagtctccagagctccaggacagcctcagagccttcagggtctggtcttgctttccccacagggcaatggtataagaggtggatattcctgtctccgtggagagaagacaggcatagtaaacccttaggaggcactgtctgtgtccatatattatgcaaagcttttggcatacatcagctcacagtgcctcacatgtgctaatatcatccctagtttattgataaag

SEQ ID NO: 84872 - DNA, 149 bp, Homo sapiens
tcccaaagtgctgggattaaaggcgtgagccaccgtgcccagcctgccctgcacttcttttagcaccattagcttctgtcactgggtgtctgtagccgtgctaggtcagccagaactatgtctttatctttccaccctcagggcctaga

SEQ ID NO: 84873 - DNA, 799 bp, Homo sapiens
catactagaattcatagtggagagaaaccttacaagtgtaatgagtgcagcaagaccttccgtctgaggtcataccttgcaagccatcgcagagttcatagtggtgagaaaccttacaagtgtaatgagtgcagcaagaccttcagtcagaggtcataccttcattgccatcgtagacttcatagtggtgagaaaccttacaagtgtaatgagtgtggcaagacttcagtcacaagccatcccttgttcaccatcgtagacttcatactggagagaaatcttacaaatgtacggtttgtgacaaggctttcgtgcgtaattcatacctggcaagacataccagaattcacactgcagagaaaccttacaagtgtaatgaatgtgggaaggcttttaatcaacaatcacaactttcacttcatcatagaattcatgctggggagaaactttacaaatgtgaaacatgtgacaaagttttcagtcgcaaatcacaccttaaaagacataggagaattcatcctggaaagaaaccatacaaatgtaaggtttgtgacaagacttttgggagtgattcacacctgaaacaacatactggacttcacactggagagaaaccttacaagtgtaatgagtgtggcaaagcctttagcaagcagtcaacacttattcaccatcaggcagttcatggtgtagggaaacttgactaatgtaatgattgtcacaaagtcttcagtaacgctacaaccattgcaaatcattggagaatctataatgaataaagatctaacaagtgtaataa

SEQ ID NO: 84874 - DNA, 199 bp, Homo sapiens
tatttaagacctactatatattcaacattattctaattattatggtgaatacagagaaacaaggctatggtttcagccttcaaagtatttgtcactttattcatctgacaagattaaataataattggagtaacaaggaacaatttaagacagtgtgaaaccagatattaatccccaaacgggaggtcaatgcaggtta

SEQ ID NO: 84875 - DNA, 459 bp, Homo sapiens
gtgccgctgcagcgccaggtacgtgaacttgtacggagcctccgtctgcaccattccccagtgctgccgccaaaccagctggatcgtcttcgggacgtcggtgtcgcagtccagccctgcggacaagcgcgcttggggaggggctacggatggggggaaggtgccggcaggcaggggcggggctgctgatgaggggcggggcttgccggtagcggtggggtcgtcctgagggttcagctgcggcggggcgggcccacgcgggctgtgcaggtgcaggtgcggcggggcagggccacaagggatgtccaccctgcccctgccatggcccggctcctcctcagggtcagtctgaaagggaatgaggccaactgctgctgttaacagaggacaaacaagtccatgcaaatgctatgcaaatgatatgcaaacgacacacaaatattatgcaaagagccctgg

SEQ ID NO: 84876 - DNA, 524 bp, Homo sapiens
cagcctgcgcaactacagcaagaccctatctcaaaaaagaaactcagatatgggttctagatatactcattgttactgagatgtaattgcttttaggcccccagaggggacaaagctaaaaaaatttatatttatatatgtggatctgtgatccatttgaagtttattcttatgcatgatgtaagatatgtgtctaattacattttttccaaatggctcagcaattatcctagcatcatttaccaaaaagttcatctttgtctcaatgatttgacatgtcattttattatatactaatttctatatgtacatgggtatatttctgtaccttttgttctattctactggtcagtctatttgtgtgccagtatcacaatgttttagttatagaagcttaatgttttaatgacagtatggctagtcccatctcataggttttcattatcagtattttcctgactaaacttgcatgttgttgtttcatatgaactttagtaccaacttagttccattttaaaaaaagt

SEQ ID NO: 84877 - DNA, 913 bp, Homo sapiens
cctgtggaagctttgttcttttactctttgcaataaatcttgctgctgcttactctttgtgctcacactacttttgtgagctgtaaaagtcatcacaaaagtctgcagcgttattcctgaaaccagagacctcaccgtgaagaacgaacaactccagacgcggtgccttaagagctctaacacttaccgcaaaggtctgcagcttcacttctgagccagggagaccacgaacccaccagaaggaagaaactgaacacatctaaacatcaaaaggaacaaactccaggcgtgccactttaggagttgtaacgctcaccgcgagggttcgtggcttcattcttgaagtcagtgagaccaagaacccaccatttccagacacaacaactaataaaataattttacaatgtttcaacaagagcagactcaagcatttgctagagattccaaataaacagaaagcctgcaaagaaatgctgatacgtggtataagaattcaaaattacattgtaaaagaatattaacatcggaaaaagtttaaaatgaatatgtgaacattttgttaagtataaattataacatttttgttaagcataaacctaatacacataatctttctttgtatatagatatataaatatctaaattgtaaaagggctggaagtatatactaacatgcccagggatgatctgagcggtgttttgttttttgtttttttggcttttcatccctttatgcttttcagggtgtgtatttgtgcgtattgctgagaacagagaaagggaggggttagcaaggaaaatgttgggggaaggatcaagccgcctttgatgggctgaattattataatgatagtgaaaacctttatctagtggctcatctttcttcaaactcacagcccacaaatcagaaatg

SEQ ID NO: 84878 - DNA, 828 bp, Homo sapiens
ggacgcgaggagggagcgcgcgagtgaagccgagctgagccgagccgatccgagccgggaggtgcctgggagaggcaggcagagcccagccggccgcctgcggctcagtaccgaccgtgccgcgtcgccgggctctgcgtacccctgtctctgcccaggctcccgcaaaacttttattctctggggcccccggggtgtgtgaaggaattggaaccttccgccatctccgcgctccccttcggcggcgaccgaggggacctgcgtccctcgtccgccgggctctggagccctgcgcctcacctgctgatcgctctccggagtctcgagggggcacccccggagggaccgcgcgggcgccggcgcccctgaactctcccgctcaccgcggcagacccgcccagcgcaactttaacttgattcttcttgcccaaccggggcaccagcggctgctgctgcggcggctgctgctaccgccgccgccgcggtctcacaaaggggctcagggaagggaggcggcgcgggcggcagggacgggcctccgggccgccgaggcggggagacaataagggaagctgcctctgctcgcgctgcctgctcggagccgcttgctcggctgcctctggctggctccgcgatcctctcccccaccctcgggcactgtccgcctccctcccggcgggctgtccccgcagtgctcccggacccggcgagccttcggggcgcgcgtcgctggtggtggttgaggctctagcgataataaatgatagaggatacaatgactttgctgtctctgctgggtcgcatcatgcgctacttcttgctgagacc

SEQ ID NO: 84879 - DNA, 1779 bp, Homo sapiens
ctggaataggtctggctctgggtccaggaggcttcagggatcagacaatgtcatcaggatctggtctctctctctctttgcctggctttttctcaggcacatatagtgactcaatggccactgcatttctaacctctcatcctcccaggttcaagtccaatgggaaagaaatatcttccttcaacagctgaatatgttactggaagtttggagaatcattactagatggcaaaaacaaaagatgttccttccattttgtgaactgcataagagatcttggggggtgggcgatgaagagaggtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggtcccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgctcccttgcttaattgtggggaatgatggctaagggatctttgtttccccactgaaaattcagtctaacccagtttaagcagatcctatggagtcattaactgaaagttgcagttacatattagcctcctcaagtgtcagacattattactcatagtatcagaaaacatgttcttaataacaacaaaaaactatttcagtgtttacagttttgattgtccaggaactacattctctattgttttatatgacatttctttttatttttggcctgtcctgtcaattttaatgttgttagtttaaaataaattgtaaaaagcaattacaaaaaaagaaagagaagaaagaaaaaatgttgtaggcgacacgcaactggggcccccagaaaaagagtttaagagacacacagtagagggagcgcgggcggcccccagaagacgataacagggcaaacagtcgtgggcacacaaaggatgtaccgaaagagagaaccccggggcagcgaaacaagacgactgaggagatattccactattacaaaaaaaagcgccgcgggggggacaacaccgacagggatttcggaaacacacatcccaaggcgagagatatgggggggaacaaacgagggagatattacaacagagagacacgacgaggagacgtatatataaatgcc

SEQ ID NO: 84880 - DNA, 1998 bp, Homo sapiens
ttaggaagggaggtatcaacttagagaaagacaagggtttagaaagagaagggaaagtcaagtgtcacctgaggcattttgtgaataagttatgtcattaatttaataacaaggtattattgatttgcttctaggtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggtcccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccaggtaagaaactgaaagcaagaggaggaagataaatgcccggagattccaagtggcagacatttcccattcaatttatggtccattaaaagctctgttttggttatgaagtcaagtagacagtgattttgtgccgaaagtaatcataatcagtcatattgggtaattgtgttcattgttgtatcagggtataggaggcaatgcttcaagtagaaagtgcctcaattaaatgtcttatcaagttctgtcaatacttgcccaaatcaatgggtttgcaaaatttgttaaagatctacttatttaccaatgagacatcttcctaggaactggctagggtgaaatgacatcatcttgcatttaaagtgaggggaaacattttgagccaaagaaacaaatgtctaattggagatttcaagcgtcaagtgggggagtatttggtgaatcggaaaagccttagaaaattgcctgttttccccttccttatcttctctcatatctatggaattaaattgtgggtaaaatgttagaactgtaactgtaatgtaatggaaattaactagtgctgtgattttcaaatttttagccaggtactctgctcatagaaatcttaaatcaaagaataaaataaaagcagacagatggctctagttaaagtgtgtatccatggggcggggaagagttaaggagtagggctgtgggtgctggagcccactctaggatactgcacagcagccccaaacccacctacctagcaaggctcaactttaattggaggacaagaaaggcctgagactcaaagtcaatttcctgtctttcaagtaagtttgccttcttatccctagatgaaaaactccagtgtcccatcttttagcaagcacatatggcaacccccaactcccagggggttcattttgcctttctgaataaatcttagaatctacaggtctccctctctgccaatgaatgtgcctctctttcagtctctgtctctctctcccagcacatgtgtatcagcctgtcctggctgatttcaggatgattacatgggccagggcaggaatgccactccaggggtacagtttttggcattgctagatgcagagaacccttaggtttccagcgtggattttgtggacagagccccagtcactgagctgcccaccctctcc

SEQ ID NO: 84881 - DNA, 359 bp, Homo sapiens
gtcaatggtctatccatcctgaaatatatagtatttttgggggcccctgccataatagttcctgtattattttttaggaaagccttccccactcccaagagaaaaagtaagttatttatatatcccacatccttatgggtctttgactttcctattctcttcccactgaattgtctatttcccaatttcagttgttacaatatttatagctttataatttgagctaatatctgccattttaaagctttttttctggcttctgttgcatttttatgtctttatttctttcagctattatacaaatgatacaacctgctatggaaaaaagagaaataacagataagtatacaaagaaaata

SEQ ID NO: 84882 - DNA, 716 bp, Homo sapiens
acaacctaggtaaaatacgtagtgtatcagttcgtgatgataggttcaatggaaaaaataaggccaagcgcggtggctcacgcctactgtatgtagtcttagcactttgggaggctgaggtgggcagatcacttgagcccaggagtacgagtccaacctgggcaacatggcggaaccccatctgtacaaaaaattaaaaaattacccagatgtggcagcatgtacctattgtcccagctgctcaaaggctgaggcaggaggatccttgagcccagggggcagaggctgcagtggccgagatcacaccactgcactccagcctggatgaaagagaaagaccccatctcaaaaaaagaatgagcagggaaatcctcaccaaggtgacaagtgagcaaagatctgaaggtgaggggatccctgggatccctggggaaagagcagtccaggtacaggaaacagcaagtcctgagggagaagcatgtttgaagaccaagaaagaggacatgctgtaagctatctgaagccacagtatacaatcagcgatggccagttttgggttctttttggtgatctgggaaaacccctagtgatgcaagcaaatatgggggatgccaggtaccagtggggttagctgcatcccactcctggctgaaacctattttagagacaggcctgcatcagggaccctgggtaacggaaagtacctttttccttgc

SEQ ID NO: 84883 - DNA, 379 bp, Homo sapiens
ctttgaaacaagcacatgtttgaaaccttaggtttctttttcttaagctttcccaagttggaagcttataacacagacatgaaagtctgatttaagcagttcctataacctttctaatttcagattttaaaactgcttttgcttgaatagaaaatggaaagccaacacatctctctctacccccatccttccctgaataacctagatacttaagcaatccttcccttccctggggctgtgactgtagagtattattttattgactcataattaagaacttctgatgagaaaaccagtcaacagagaaaaatggcttgggggtcccacaagcaaagagaaagcctgtatgtccctattatggcaagtacaacaggcagga

SEQ ID NO: 84884 - DNA, 197 bp, Homo sapiens
gatctgtccactttgctctcacagacgtggcatttgccaggaaggagaacccagcaggaacggaggtctctgccttcacctacagtgaaggcagctggtatgtgaaatactttcactgagcttagtgaaaaattcattttacaccctagttagctcccagaaaggttgaactttcaagacactcaaaatatgaagcc

SEQ ID NO: 84885 - DNA, 332 bp, Homo sapiens
aaaagctggatattaggaaatgtgaatattaattctgaatttgttactgactcaggatgaccttgcatgatgcatccaaccttcttttctctatatcagaaaactaaagaataaatgtaacatcacattcttttctcctttgggacaaacaactatgtacaattgaataaaaatgaaattgcataagtagtggatagaatatgtttgggttggtttgaacttagcacactgtttaataattcaacattttttatacctgtgcaataaatttttaaatgatgtctgaaatgctttgaaatcttcagaaacaggtttataaatggcataaaaaa

SEQ ID NO: 84886 - DNA, 702 bp, Homo sapiens
ggagggggtgtgaaaagccccaggcagcgtcaggggttgtgctcctgctcctgtttgatagagagaggaacacccaccgcacagggctgttgcagggtcagcgatagcaagcaggccacagtgtttggataagacaggcttgtaaaagttgccatgcaagactcctaggaaataagtccgctcagtcctgggaagatgcccctgctgagctgccagttcctgaagggtcaccgggagcagcgcctggcccacctggtcctgagcttcctcaccatgggttatgtctggcaggaaggagaggcgcagcctgcagaggctcttgttcaggccacgaatgctatcttgcagcccaaccaggaggccctgctccaagccctgcagcgactgagactgtctattcaggacatcaccaaaaccttaggacagatgcatggcatgtagaaggctggggagtgtagtatagagttggatagcatcgaagctttcttctaaagttcctggaagagctacactgtggtttgaacgaatgtgtccctccaaaattcatatgttaaaacctaattgtgatggtgaggtattcgaaggacacgggagttgaggcattaccttggacgtggagaccaggccctcaccagacactgaacttgccagcaccttgatcttggacttcccagcctccagaactgtgagaaatacatttct

SEQ ID NO: 84887 - DNA, 481 bp, Homo sapiens
ttacaaatgtaaactgaccttcaaatgggagagaatgtagaatcccaccatgtgccccaaataagagaaagccagaatatgtatgagcagtcctaatgattataacacatgaaaacatctccccaaaatcgctgcctagagaggacaatatactattctcatttcccctaaattgaaaggggaactggttataaatacagaatattttaggatggtgcagccacagtgaaaaatgtaactcgaaggagaggggttggaatagcgatggtggtggtgattctgcacattgagtatttattttcagactgccacgacctttctacctcatgctactataatttgcatatatagttattcatgatcctgtatgctgtgggaggggcaccaagatagcatcctaagcagtgggtttacagaggtagcaactgtgaattccagatgcaaagtttggcatgaagctggggttgggaaatataatcaa

SEQ ID NO: 84888 - DNA, 835 bp, Homo sapiens
cagtgagggcgcagactgtactggcctgtgcggagcaaggcggtgtttctgagaggaatgcgcagctgaagagagaggtgggcagcaggcccggtcacctgccaggtgaccacatggccaggtgccgccaccactcgggttacctggccgatgacgaggccagccactccatgtgcagtgcacgggtgcagctgcccaagaagccactggtcccagaaatgcggccagcctgcaagccgggccgtgtgccacacccaccatccacatgtggcagctcagcactccagggccaacgccgaaacaagaggcaccctcagccctttggccactttctggatttcctaactgagagccaggtcctggacagcctggagacagtggtggagaaggcgactgagcgcatggctgccatgaagacggaggctggggtgccgcttgtggaggtgcaggacccagtggaggtgccaagtggtggacggcgggcacatgcccggcccagcctcagcaccgtacaccggcaccgtgtacggccgaccctctgcactggacaccccaacaactacccatccagctccagctccatgtccaactgccatagcagcctcatggccggctgtctgggctcccacagccgggacagtgacctaggtgcccaaggctcattgccacctgtgagggacaaactcctgctggagaagaacctcaagcggctgctacagctggagagggaagggaaaggcctcagtcagtcctgctcccagagggactccctgctgtgggattcgctgggtagccagaccagctttcagtggacacaggagcagcccttgtcctg

SEQ ID NO: 84889 - DNA, 818 bp, Homo sapiens
ggagaccctcaggttgtctccccaccccacgcagagaggaatgcgcagctgaagagagaggtgggcagcaggcccggtcacctgccaggtgaccacatggccaggtgccgccaccactcgggttacctggccgatgacgaggccagccactccatgtgcagtgcacgggtgcagctgcccaagaagccactggtcccagaaatgcggccagcctgcaagccgggccgtgtgccacacccaccatccacatgtggcagctcagcactccagggccaacgccgaaacaagaggcaccctcagccctttggccactttctggatttcctaactgagagccaggtcctggacagcctggagacagtggtggagaaggcgactgagcgcatggctgccatgaagacggaggctggggtgccgcttgtggaggtgcaggacccagtggaggtgccaagtggtggacggcgggcacatgcccggcccagcctcagcaccgtacaccggcaccgtgtacggccgaccctctgcactggacaccccaacaactacccatccagctccagctccatgtccaactgccatagcagcctcatggccggctgtctgggctcccacagccgggacagtgacctaggtgcccaaggctcattgccacctgtgagggacaaactcctgctggagaagaacctcaagcggctgctacagctggagagggaagggaaaggcctcagtcagtcctgctcccagagggactccctgctgtgggattcgctgggtagccagaccagctttcagtggacacaggagcagcccttgtcctg

SEQ ID NO: 84890 - DNA, 390 bp, Homo sapiens
agttattttttagagatgagattaacatttaaatcagtcaacttctagtaaagcggattatcctccataatgtgggtgggtctcatccaatcagttgaaggccttaatagaaaaagactgacctcctcagaagaaaagggaatcctactagcagatggcctttggacttgaagagcagctcttccctgggtctccagtctgctgacttattctgcagattttggatttgtcaagcctttgcaatcatgtgagccaatttcctaaaataaatctcatcagcaaggtggtagaatagaagttatcgggcctcattctctgttcccctctctcccagaaattcaactaacaactatcatcaggcaagaataccattgtgaataacccagaact

SEQ ID NO: 84891 - DNA, 316 bp, Homo sapiens
gtttaaaatcaattcatctttgcccactgccccaaatctattcttcctacaggtttcatttcaaaatatggtaattccaaagagaaatatttaggccaaaaatctctacccatccttaattgctttttctctcaaacccctcatgtccatttggtcagctaagtttgtcagctttaccttcaaaatgtatgcagaatctaaccagttgtcattactctgacagctattagatccaagtgatgataaatatgtgaatggattattgcaatagctttttttttttttaaagaaagaggtttatttaaaggaattgctc

SEQ ID NO: 84892 - DNA, 391 bp, Homo sapiens
cagaataaacatttactattaggagagtcaaatcatttattttcacatgaaagagattaagtaaagcagaatctttgatggtctgctgtgaattcttcgcggtgattgagaaatttctgaaaaccacttccaaatcaattataatattaagtaaactttggctttaggagtaagagagagaaggtctgcgtccatgttgggaaagaatagatatgcccacaataattagtctattacttgtttgaaaagggtgatttcctcgtcatttcaaagtattaagcaaataaggacatattgagtatgtaattcatggaaaaataagaaacttcttacagtatgattcctaaaggattatgatgcattatcatttggagttgttatgaagcttatc

SEQ ID NO: 84893 - DNA, 915 bp, Homo sapiens
atctcaaaaaaaaaaaaaaaaaaaatgagggcgttactgtgactttacagcaattaaagtgattataagataatactataaacataggtacactagcaaattgaataaccaaatgaaatggcaaatctctagaaacacaaagcctaccaagactgaatcacaaataaagaaaaaatatcggcaaaccagctgggcatggtggctcccagctgtaatcccagcacttttggagtgcactgcattgcactccagcctgggggccaagagcgagtcttctcaaaaaaaaagaaagtaggggtaaacctataactagtaagaacattaaattactaattaaaatcctttcaacaaagaaatacccctgactggatggttttaccagtcaattctaccagacatttaacgaaaattaatgccagtcctttgcaaactctttcaaaaacttgaagaggaggaaatactttctaactcattctatgaggccagcattgccttgatgctagggccagacaaaggcactacatgaaaacaactgaccaatattacttatgaacattggttaaaaaattcttaagaaaacactgccaaactgactgggcacagtggctcatgctggtaatcccagcactttgggaggttaaggcaggtggatcacttgagctcaagttcaagaccagctgggcgtggtggcccacgcctgtaatctcagcactttgggaggccgaggcgggtggatcacgaggtcaggagattgagaccacggtgaaaccccgtctctactaaaaagtataaaaaaattagccgggcacggtggcagacacctgtagtcccagctactcaggaggctgaggcaggagaatggcatgaacccgggaggggcagtttgcagtgagccaagatcgtaccactgcactc

SEQ ID NO: 84894 - DNA, 573 bp, Homo sapiens
ctgggggcagtcttgacccatgggacactggcactgtctggggacatctgtggtggtcacaattcgggggggtgctcctgagatggagtgggtgggggccagggttgctgctgagcacccctcagggcccagggttcagcaccggtcagtagagctgaggccgaggatccctggcctcagattgcatcccctccatgccaccgcccttctcttcagggcgcggtgagggaagggcgtgtgggggtccctctggggagaaggtgttttcaccttcacactcaccctcactcctcctgtcctggaacttgggtgggtttgaccttttgtggatgaggtgagggctgagaggtggattactacctgagacaatcaaaatcaattttctttcttctgaaaaggactcagggtgtttgagaaaagtactggggagaggcagctgccaccggggctccccactcgggatgtgttgggtgttttgcgagaccccccacagggagctcaggtgctgtgggcagttcctgggctttgtcgagggcctcccgaaggcagcactgtggccaccgtgggacacat

SEQ ID NO: 84895 - DNA, 460 bp, Homo sapiens
  misc_feature (419)..(419): n is a, c, g, or t
  misc_feature (456)..(456): n is a, c, g, or t
ttaagttttctgaggctgggcgtggtggctcatgcttataatcccagcactttgggaggatgaattttattttaatcccattaggactccaagtcctggccatgcagcttaatagctatatggccttgggcagggcagttctattagaggtgacttccttgggcatccctttcgtctttttttctgagagatgtaaactcgctgttgtcgccaggctggagtgcagtggtgcaatctcggctcactgcagcctctgcttcccgggttcaaccgattctcctgcctcagcctcctgaatagctaggactacaggtgcgccaccatgtctagctaatttttgtatttttagtagagacggggtttcaccatattgggctgggctggtctcaaactcctgaacctcaggtgatccgcccacnttgggcctcccaaagtgctggggattacaagcgtgancaac

SEQ ID NO: 84896 - DNA, 720 bp, Homo sapiens
atgcagaccttcccagttgctggggcgctggaccctgctatactggacacaagcagcccccaagccctctacacggtcctcttaatagtgctggtcatgatgagcttggtgtttggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 84897 - DNA, 852 bp, Homo sapiens
atgcagaccttcccagttgctggggcgctggaccctgctatactggacacaagcagcccccaagccctctacacggtcctcttaatagtgctggtcatgatgagcttggtgtttggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtttggtatgtctctttcttctggtggaggtgaaggctgagggaggtgcacctgcctaactgccctaccatgggtcaggtaagggacccccagctctgctgagctgtcctcttgtcctgccttggtatgtgattt

SEQ ID NO: 84898 - DNA, 664 bp, Homo sapiens
ttgcttgaacccaggaggcggagattgcagtgagccaagatcactccactgcactccagcctgggcaacagagcaagatggtctcaaaaaaaaaaaaaaaaaaaaagatttagaaatactgtctcatcactgaatttgcaagtacttacatttctttattttttaaaattttctttatttctttagagacaggggtctccctatgttgcctgagctgatcttgaactcctgagctcaagcagtcttcccaagtagctggaatacaggcgcaggccaccatgcctggctgcttcagttttaaagactttgtcagctcaagcatgttaataaaggaaaagaacctttcaaacatatttttatagaataattcttcactgttcttatctggcttatcttctaatactcttttcctgttaaaaactactgaaaaaaaagatggtgcatatgcaatgaatagtcttaaaagcaacaacctattttgttttcttttttacccctcatgaagacacagtaccaattagtttttgtgaatgtgttataagtatgcccaattgtctgaattggtaaatcatataagactgatataatctagattaatttaaattatctgtttgtgcaaacaaaagaaattggattatgtacccattaaaatgatataaccacc

SEQ ID NO: 84899 - DNA, 1361 bp, Homo sapiens
ctacaaaaaatacaaacattagctggggatggcagtgtacacctgtagtcttagctactcgggacgctgaggcaggagagctgcttgagcccgggaggtggagactgcagagaaccgagatcatgctgctgcactccagcctgggtgacagagtgagaccctgtctcaaaaaaaaatttttttaaagagtaaataacacacacacacagcagcgcacacactgtgcacctctaaacacaggactccccctccgcccccgccacatatgactagacctggtggggcatgaagcacacactgcacactgcagctacaaaaggtcccctggcttggtctaagggacagagtgtcacaggttaaagagagagagagagagaagaaagggcccccccccgcaggtttggggcacacgtgctggtgaaccctagcgccactctacccctcattcagctgtcctcagttccaaaagtctccactggcacagcacagcagtctggttccacgtccccgctgtttggcccgggcccggtcatactcaaaggtgggccggctatgctgtcaatactacgtaaagacaaggaggccagaaggtgaagaaccaggcagagcatgatgagtcgtggggccatggcgaggtcaacggtggtcggcagggccacaggcatttcaaaggaggaccatccacagacactaaagtctgggcagcatactgggttgaaaactgtcagaggattcctcttaagtttttgaggtccccaaaagcaggcagtaaagtggggccacagtgtttgaaggcccaaggatcccctctgtgggctgccttcatctgtttcagaggtacctgttacaggttgaattcgtcccatcctaaaaaacgtttatgttagagttctattccccagttagcccctaaccctcagacagtgatcttatttggagatagggtatttatagagacaattaagttaaaattaggtcattagggtgggccctaatccaacatgattggtatccttataaaaatggaaaattggacacagacacacccacagagggcacgccacgtgaagatgaagacagatcagaatgatgcacctccaagccaggggacaccagagactgccagcgagccagcagaggctgggagagaggcctgcgacagattcttcctcacagcccacagaaggaaccagctccactcacaacttgattttgcactccggcctccaagactgtgagacaataaatgtctgttgcgggagacatcaggtttgtatcactttgttacacagccctagcaaactcacacaatactgtcctccccgctttcttcttcctgctattcctgccaagtttctttt

SEQ ID NO: 84900 - DNA, 461 bp, Homo sapiens
tcttgcaggggtctccagatcactgctcatgctagtgtcagggttcgtgtgggtagagaaactctcctgtggttcagataacaatagtctgtggcaaggatgtggacaactgaagctttctcacttaccttttccccacaataccaatccccttgctattggttgatcttggttgagccagctgcttgcttccttccccttctgtgcctcaggtattttttttgagctctatgttggattctagtgttctctcttagatgtcctgtttgaggtatgattgtctattcacagtttttattctttctgaagagggcaggtgtctcatgtctctagttagccatcttgtggcctcttgattttagcccggtgagatccatgtaggacttctatttacagaactattatttttcttaaagtctaccaaattgtacaaacttcaggcatcataaaacttaggtctt

SEQ ID NO: 84901 - DNA, 417 bp, Homo sapiens
gcagggacatggatgaagctggaaaccatcattctcagcaaactaatacaggaacagaaaataaaacactgcatgttctcattcataggtggaaattgaacaatgagaacacttggacacagggcagggaacatcacataccagggcctgttgggaggcggtgctgggggagggagagcattaggagaaatacctaatgtaaatgatgagttgatgggtgcagcaaaccaacatggcacatgtatacctatgtaacaaacctgcaagttgtgcacatgtaccctagaacttaaagtgtatatctatctatatctataactatatctatatctatatccatatctatatctatatctataaacacaaactgtaagttgagtagtgatattctttacaaatataacattagaactgtga

SEQ ID NO: 84902 - DNA, 471 bp, Homo sapiens
gagccggtattttgtatttagtagagacaggttttccatagtggcagactggtcttgactcctgaacgatcctcccacctcggcctcccaaagtgctgggattacacgtgtgagccaccaccacacccagccattatttcttattttgagaaattattttgcctggccctctgtgatcattttgattggtctgattttgactttacctgctaaaaacaaaacaaccccaaaactgttttatctctatcattttctggagtcaccttttaacttagtttatctgttaactttacttcccttttatctttcatttaaaaatacagactaggaaggggcaacacaagggccacagacatggtgataggccaggtcctaaatcagcaggttgggtgctggtgccttctctggtctgttctgctcttcatctcttcttttcatgcctcacagcaagacttatttggtcctttggag

SEQ ID NO: 84903 - DNA, 1409 bp, Homo sapiens
ctctggatgcaagtgtctagacactgtagtttaaagaataatttcctgtagaaaaacctaatctaataggacctactcataatttggcaaaatcatcctcataattccatgctactgaaatgggggtgtaataaagaaaaaatcatttgtttattcatttaacagggtttattaagcaccaatatatgcccagaactttgcagtgcactggaagttcagagataagaaaaccacagtttctgccatcaaaatgctaggaatctagaggtctcaaacatcagaggtcccttcaaactatgtctaccaggaaaataaaatacctgatttcatccctgcaaacaactctatacagacagaaatgcttcctagcttggaaactatagaaaattgaacatgaaaatgagagcaaagattctacatcaaaatggcaatgatccaatcagcccagtcaaggctgagtgggttgaatggggacttcgagtttggattcaatgctttgaacttcatagctccagagaagctgtgcaaaaaggggggattctagggaatctgaggaagattgttggagaaaccagctttcttcttgtctcctaatccctgctaagattgataccagtcaaggagctgagttactttcatttcattatgttgaccagagaagcttatgatacagacttgacacagcacctatttcaagagaaagatgttactctacttatgggaacctgcagatcaaattctcctggggcaagagaagaaatttgttcagcagcctaagaagtcaactgtactttggacagtgctgccaaacacaccccaggattctcccacccctgtgctttcccagaagatgccacatagctggtatttggttttcatgaataaccaaagattcttctttgcttcctgaaccccaggcatccttaggaatttgcttcatgtcctcacttgtccttgaaggcttgtttttcaggatgaacttttaaagtctaagttgtttatattcaaatcaacccaatgctattgttgctgatattaaaccattccaaactgagccaactggcccctaaacaagccagcaggcagcccctcactaatgcccagtttagaacatgttaggaccaggctatctgcatagctttagtggttttagaagccagtaatggcagtgtaaaagaggaatcatacagagatgacctggaagaaaatttgagtttcagcacattcaaaagcatttgactcttctgccgtgttttgattttcaagtgagacaatcaatgtacacacaaagcctctagtacaatgactgatgcatactagggactgttatttatgttatttttttacagtatgcatggacttcattgtctcagtctttggtgttacttatgaactctaaatttacacca

SEQ ID NO: 84904 - DNA, 722 bp, Homo sapiens
ctctggatgcaagtgtctagacactgtagtttaaagaataatttcctgtagaaaaacctaatctaataggacctactcataatttggcaaaatcatcctcataattccatgctactgaaatgggggtgtaataaagaaaaaatcatttgtttattcatttaacagggtttattaagcaccaatatatgcccagaactttgcagtgcactggaagttcagagataagaaaaccacagtttctgccatcaaaatgctaggaatctagaggtctcaaacatcagaggtcccttcaaactatgtctaccaggaaaataaaatacctgatttcatccctgcaaacaactctatacagacagaaatgcttcctagcttggaaactatagaaaattgaacatgaaaatgagagcaaagattctacatcaaaatggcaatgatccaatcagcccagtcaaggctgagtgggttgaatggggacttcgagtttggattcaatgctttgaacttcatagctccagagaagctgtgcaaaaaggggggattctagggaatctgaggaagattgttggagaaaccagctttcttcttgtctcctaatccctgctaagattgataccagtcaaggagctgagttactttcatttcattatgttgacccacgagttgtttacagacacgactttgacactctacatccagagccggatcctatagagtcacctgac

SEQ ID NO: 84905 - DNA, 744 bp, Homo sapiens
ccgggtagaggcaggcccacagcatgtcctccaaggtttactccacaggctccagagctaaggaccaccagccctcgggtccggagtgtctgccactcccagaggccaatgctgaagccatcgacttcctcagctccctccgtgagctcagacagtgtcggggttgggggtgcgggaggggtgcaagtctggagaggagggaagaaagtccagtctctctctctctctctctctctctctctcttccttgattctcctgggactcagaaaaggcctgaggcctgtttgttgacattcttcaagggaaggccccccggggacatggggacatggggcaggagtcttcacctgtccgtgccagtgaggaaggctgtgggatgaggaggcaggtggggactgtggggacactggtggtcatggggtcagaggattggattggggcccaggagcaggggctttatctgttcccacgggcccctcaccccagacaaggaggagctacagatgctgttcttctctgagacgctggccatggtctcagacaccggggagcctcagggagagctgaccattgaggtgcagagagggaaataccaggaaaaactcggcatgctgacatactgcctcttcgtgcatgcctctagccgaggcttcttggacaaaatgctctgcggaaattccctcctgggtagcgttcctactgcctgatgcccgtcactctccccttcctccaaccctcccctc

SEQ ID NO: 84906 - DNA, 439 bp, Homo sapiens
cctgcctcagcttcccaaagtgctgggattacaggcgtgagccaccacgcccagcccctccgtgatattttaatagcctccagctctgtgatattctcgtgatattttaatagcctgtttagcacgtattcacaaccagccaggcactgtgttcagctctttacctataggtcatgactgctattatcccattttacaggtggagaaactgaagcagggacaaagacttccagaaagatagcacgcaacacacctgggaggcatctacgcaattcagcggcaaaagacggccgggcgtggcgagacccgcctgtaactcccagcactttgggacggctgacgaccaggcggactcacttacgcccaggacgttcaacaccagcctgggcaaacatagtgacgaccccatgtctctattataaaatacatagatacggac

SEQ ID NO: 84907 - DNA, 152 bp, Homo sapiens
tcccaaaggactcacgcctgccacagaagctgtgacctgtaagccactcccccagtcctgtttccaaatctgtatcatgagagtaacaaccgtgccacttgccagggcgctgagggttaactgaggctggcccgtggcacgtggagagaatt

SEQ ID NO: 84908 - DNA, 404 bp, Homo sapiens
caaaaacatcaaacaccgcaatctcaatacaatcattatactaaaataattaataatttcttaatttttttcaaatattacaccgtgttaaaattttctcagctgctacagaaatgctttctcacaatttgttttcaaaattagtttgacttctaatgaaaataagactcatatattttaattgtttaataggtctcttaagcctccttcgatctaaggttttctttctttgcaacttatttgttgaaaaatctggtcactttgtcagtagagtttcttgtagtctaaattttgctaattttattcctgtggtgttattaaaagtatttttttctgtcctctgtatattctataaattgataaccagatttaagagcttactcagattaagattgcggtgtttg

SEQ ID NO: 84909 - DNA, 300 bp, Homo sapiens
agtgtcctgcactgaagcatggtacaaagaggtgggctggagagggacggttccaagagcagctggccaccgtctgctgccctggcgtgcccgcccattgtcctcactgtctgccacaccctccctagcaggccatacaaggacatgtcctcccaatgtcctgtcccccggcctcaggctcagtctttcagaattggcctccctaatcccattccgtccaggctctgctaagagacagccagggaagcttgcaggtgaatgtgcgtctatgagcaggcgttgtgcatgcaaacagccctg

SEQ ID NO: 84910 - DNA, 460 bp, Homo sapiens
tgaagccttagagttgcactttagaatctatattgactaggcaggtaaatatatatttattgcatttaactaactaggtaggtagatagatgagcttaaatactagaatatcctttaaaggaaaacctgagacatttttcatatctgaagcatcctacaaaaatatctttgcttttaaaaatggatacgtttctagcatgggcagcaaaacaagactctgccgctacaaaaaaatagaaaaattagctcggtgcagtggctaatgcctgtagtcccagtactttgggaggccaaggcaggaggattgcttgagcccagcctggacaacataaagagacctcatctctacagaaatttaaaaaatttagttggccatagtggtgcacacctgtaggcccggctactcaggaggctgaggtgggaggatcacttgagcctggtaggtcaaggctgcaatgag

SEQ ID NO: 84911 - DNA, 388 bp, Homo sapiens
ccctaccatgtaattgcccagttacatgttcgcctctcccactacacttaggatctacaagagtaggaactatgcctgctttagtcaccatgatatacccaggatgtagcacagtgccagacacacagtaggtcacgaatatatgttaaatgaacaaaaggaagggagtgaagagtgaggaaggaaggaaaagaaccacaacaaagaaggagcctgttcctgagaatggttgaaagatggagtctgaagtggttccctgaaaccctgtaggtttaaagcaagatgcctatgccttttaaagttgggtgcctgtggctttagccatagtagacaaggagctagacaagatcttgttgttccagagcagatgttaaaaactatagtttcc

SEQ ID NO: 84912 - DNA, 337 bp, Homo sapiens
ggcccagggttagccttcagctctgcccccaccctagatcctactatagctggaaggtggcgaccatttgaacgtgggacaagggaccatttctccctagcaagatgaagtcacttacccaagcctttgtgacaagtccgcatcagagccagcccagagctgcatctcttccagccctaagactgatgagatagatagatagatatttgccttcagaacaggaaggctttttgttaatgactttttgttaatgtttcagggagaggagcagaggagctcagtccagtatgattggcatttggtgaaacctagtggtgcaaatgttctgattgggatg

SEQ ID NO: 84913 - DNA, 627 bp, Homo sapiens
gagtatggaggtaaatataatagttcagaaaagaaattatagtgtctaggactataggtagtgatagagagtagagagattcaaaatagatttaggagtaaaatcagccagatatactgattgttttgatgtagaatgagggagtataaggataaatgttctgtatttctagcacatgcagttggtagtgccatttataaggcagagagtttttaatatataaaacactgccttatggtgcaagagcttaatcatttttaatggttgcataataatcagatacacaaatgtattttcagttcccagaaataaaacatctgttaatgtgtagtgaatatgatgttttgaaaattagtggtgaaaggctgggcgcggtggctcatgcctataatcccagcactttgggaggccgaagcgggcagattgcttgagcccaagagcttgagaccagtctgggcaacatggcaaggccttgtctctacaaaaaatataaaaattagctggggcatggtggtgcacgactgtagtcccagctacttgggaggctgggacgtgaccattactggagcctgggaagttaaggctgcagtgagccatgatcatgccactggactccatccagcctgg

SEQ ID NO: 84914 - DNA, 867 bp, Homo sapiens
gccactcagtctgtggtacttcgtcaaggcagccctagcaaaactcttccaccttctaatgacttttagtcatctctggaataaaacccacaggctctaagaagtttctaaggcctaggatgatctgactgactcttgcctctggtgcctcagccttagacacttcctgcctctctctactccagccacactagcctcggtgcagttccacatacatcatcctccttcgtctggagcctctggatgtcctgtttctttggcttggaatcctcctacctgctcatgctacttactcacctcgtcagtagcaccacccttcaagtctcagcttaaacatcgctccttagagaagccatccttgttcccttagactagggaacaagggaatctgtggtaattctgtggtaatcttccacagaattttgtactggtaatttacagcccttatgatcctccagtcacttggtcaacatatctcttctatgcaagattgtatcctccaggtctcaggaaccatttctgctgtatctgtggtatatttggtgtggtatatatgtatttgaatgaagcctcagaatgaacaggctaacagttgccaggatcatgaccattctggcaggaaaatggacagaactgctttggacacggtagtagtaagatttcccctgattatcaaaatccaattaggtagattttgtagctgaagtaatgaagtgattacctctagaataatttgttagtaattcaattcagtttatgaggcaaaggttatatttttattttttcagtcaactttagcaaatgttcagaatttttggaccagatgtatagtaggtctaattcattttgggatacatatgaaacaat

SEQ ID NO: 84915 - DNA, 435 bp, Homo sapiens
accacagataaggggggactactatacatattttcagttttccgtattttccccaaataattttaactcatcaaagtataccattattttatacaaatatttctcctgtatctttcttttatgttaatatacttgacacagccgttagcatacattcccacagtacttagcacttggaggatacagagaaagtaaaaaacacattactgccttgaagaagttaagagtttagttggccaattgaatttttaatgcaaatatccagtataaaatgctgttttaagactgccacaaaataaaatattgttttataaatggaaatgaaaatagattttgccaggtgaagtggtgtgcacctgtagaggcaggaccacttgagcccaagtttgagaccagcctgggcaagagagtgagaccccatcttaaaaaaaaaaa

SEQ ID NO: 84916 - DNA, 381 bp, Homo sapiens
gataattgattcaacatttgggagggggaaaattgagtttatcatcttaacaaaactcagcttcctaacagattgaaaaccgaagtgtaactaattcatgaactcttttaaaacacatatgtacacatgcacgtatgcaaataaatgcctgatctttggagcaagaaatttttgagcttaaaattattaaactgtgtgttctatgtgtgtgtttaataaaaatatagagaaatgaaatacaccattttaatcaaaatctgaagttaaatcacaaatgaaagatttgagacagataaatggctaatatccctactttataaagaactccctgcaactgataggaaaaaaagccattccgttattatatggacaaagggtatg

SEQ ID NO: 84917 - DNA, 396 bp, Homo sapiens
ctttttgtaggattagtgcagatgttaacagagtaaggtctgtcttagtagtattataaaaacagttttgactttgcattttcgtgaagggctcctgggaaaccctccccatccccagtggcctgtggaccacactttgaaaactgctgttatttacactgctttaaaattgccagagatttactaatgtattgccaactatgaattaagctgcagtaaatattgaaaaattacatacttccacttaagaaaaatgcataagaaatatatcttttatgctttatggagaagttatgacttttaagcttggtattatctttaagtcaaattttaataaaatgattatatgcatactggaattactaatcactttagctccgaacttcatggcaaatg

SEQ ID NO: 84918 - DNA, 521 bp, Homo sapiens
acttaccatttcttttgaatttaatatgaattgtctgatgatctcagaaccaagtagttaacaaggactaaggaaggttacacataaactaatgatgacaacaaaagctatcttcagtgatcaagacttgaacattaaaatataccatctgatggtgtaagattaaagaaaaagcaaaccaaaaatgtaccatctgagataaattagaagctcaatccaagtcctgtgaagtttacaaatgaaatcactgaagaactataaactatctttgaggaataatcaaaagtacagtgctacatgaagcctaaagaaaggcagataagatcttgattttcaaaagagaaagatgaattcttaacaaaataatatgtgtcaagccaggtgcagtggctcatgcctgtaatcccagcactttgggaggccaaggcgggaagactgtttgagcccaggagttcaagaccagtctgggcaacatagcaagaccccgtctcaagataaacaaataaataaatttttaaatt

SEQ ID NO: 84919 - DNA, 649 bp, Homo sapiens
ttttttttttttcatttttcatttggccgcatggattcttaatgttagcttaattatagacataaagtggtttggcagtagctagcaattcccactactccttccactcgtcctcctaaagaagggttataaactcaggcaaaaaaaaaaaaaaaaaaaaaaatgccaggcctcaaaaccaaagactctatcttactttgcctcaagtttgcaagttggtaaaaaagctgccggtaggcactcaaaacaaaacaaaacaatactgggtgactgctggactaaagagtacaaggtgacgagatcaagtatcccgctagccacagactagctctgggatggccagagagtgtgaccccagcacctccgctctctgctttcaggtcctaaactgacaccagtaaaaggacgactgggggtaccgcatgaggaagaaaagacttagggcttggcccgcctgctgccactgaccctcgtgtccccaacacagatgccgctaagagctgcggccagggagctcagatgggtccccaaaagaggcataggaaagcgcgacctcactgccgcggcagccgccacgcgcaccggacctgtagaggccgctcgcgcctacgcctcccggggcaacgacgcgcggcaggccgcggccgcc

SEQ ID NO: 84920 - DNA, 357 bp, Homo sapiens
ctcacacatttccatctcttttcagaactcctgacctgtatacatagtccaacttaatatcttcccttggatgttaaatttaagccctagagctcagttcctgatctatgctccagaactggcctccatacatccttatctatccgagttaatggtgctgcagttgatcaggccaaatccaggagacatccttattattttttttctcagatcttatatctaatattttaggaattcctattaatatatacctcaaaatccaaatatcttttgccacctctacagcaactcccctggtttaagccaccagcacctgtctccttgactgtagcaatggtctcttacctattttcataa

SEQ ID NO: 84921 - DNA, 338 bp, Homo sapiens
tggaaggatattaaaaagctaatataatcatacgaaaataatcatagttatgcggggtggagtggaagcaggaaacgtttcactctattccttcaaatatattcaggtatattacacctttatatattttattatatgtatttgaacaatgagtatattaccccttcaaagttacataaatatgaatgcaggaaatctatatggacagatgcataacaattttccatatatagttaaacagaaaaagcaagtttgcagaacagtgtgtacagtatcacttgtctaccacaaaatgtgtgtgtatatgtgtgtatgtgagtgtttatatacatacatat

SEQ ID NO: 84922 - DNA, 152 bp, Homo sapiens
  misc_feature (1)..(1): n is a, c, g, or t
  misc_feature (117)..(117): n is a, c, g, or t
nagggccagagtcccaccccagagagccttggtgaatccgctcaggcccccggactctgtgcattccccaggtggcctggcccatggccagctccctctctgtacacagaagtcagnaagaggctggggcagctgcgggggctcagcttgag

SEQ ID NO: 84923 - DNA, 218 bp, Homo sapiens
agtcgtttcccacccggggacactgttatatagtcggccacagtatttagaccggtccttggggaagctgatgccaggcactaaccagtccctgtctagtctgcaaaggcagcttgaactttcatcctataaaccgctcctcttctccattaacttgcctttatgtaaagatgtttgccttacattattttatttatttttgagacacagtctcactc

SEQ ID NO: 84924 - DNA, 1040 bp, Homo sapiens
gttagctaataaggtttgtcaactcagaaaatattaggtctgctgactgaacatatttcacagacttatacacaaagcatctctgaaagacactgaagccaaatttttcaaaactgtccttgattttgacctacactctgctatctcaggatgtgatcaattcctttcactttcagcatctataactcagggtctaaaagatacaacagagatatatcaacctaatataaatattcagcaaaccaaaaatagaaaattcaaatttagatccttcttgtagttttctagttatcaaaaggaaatcttatactaacataataaaatgcagtatttaatatttctaccaagattctcaagaaacaccaccattctctgtggtctttcaagtgatccatggcataccgtctttcaactttttttttttttttttttttagccccgatcatgggcaagggcagcctttcaactgtttttgaacaaagaagacagtaattactaaatatgcagtgttaacatgtatatccagattctgaaaatgtgccctcaaaaaaaaaaaagatcttcccaaactatcattccacacatttaacctccttccataccaaatctttctcataaggaaaaaaaaaaaaaaaaaaaacgaattttattccctcttccctaatttcttgctatgaaggattggatacttatcacactaaaaaaattatgctgaaatgtaatccttaaggggcattttaatttctcattttttatttcaaaactgccaaacagaaatgcgaatttcagatatttaaagccagcccatagtgaatacagtgctacatcaagaggaaaacggccgggcgcggttgctcacgcctgtaatcccaacactttgggaggccgaggcggggggatctcctgaggttgagagttcgagactagcctggctaacatagtgaaaccccatctctactaaaaatacaaaaattagccaggtgtggtggcacacgcctgtaatcccagctactcaggaagctgaggcaggagaatcgctt

SEQ ID NO: 84925 - DNA, 981 bp, Homo sapiens
gttagctaataaggtttgtcaactcagaaaatattaggtctgctgactgaacatatttcacagacttatacacaaagcatctctgaaagacactgaagccaaatttttcaaaactgtccttgattttgacctacactctgctatctcaggatgtgatcaattcctttcactttcagcatctataactcagggtctaaaagatacaacagagatatatcaacctaatataaatattcagcaaaccaaaaatagaaaattcaaatttagatccttcttgtagttttctagttatcaaaaggaaatcttatactaacataataaaatgcagtatttaatatttctaccaagattctcaagaaacacttttttttttttagccccgatcatgggcaagggcagcctttcaactgtttttgaacaaagaagacagtaattactaaatatgcagtgttaacatgtatatccagattctgaaaatgtgccctcaaaaaaaaaaaagatcttcccaaactatcattccacacatttaacctccttccataccaaatctttctcataaggaaaaaaaaaaaaaaaaaaaacgaattttattccctcttccctaatttcttgctatgaaggattggatacttatcacactaaaaaaattatgctgaaatgtaatccttaaggggcattttaatttctcattttttatttcaaaactgccaaacagaaatgcgaatttcagatatttaaagccagcccatagtgaatacagtgctacatcaagaggaaaacggccgggcgcggttgctcacgcctgtaatcccaacactttgggaggccgaggcggggggatctcctgaggttgagagttcgagactagcctggctaacatagtgaaaccccatctctactaaaaatacaaaaattagccaggtgtggtggcacacgcctgtaatcccagctactcaggaagctgaggcaggagaatcgctt

SEQ ID NO: 84926 - DNA, 378 bp, Homo sapiens
aaaggaaagattggaaagagttgcgggaaggaaagcaaatgtcccttcagacatgtgattgtgccacataggaaggaacagaccctggtttgaatcccagccttactgtgtattgaccctgtgacctttgggagatgagttaatccttgcaccacattttccttggctgcaaagcacctcaatttgcaggttcctttgagggctgagattatatacataaagcatgtgggctagtctcctctggtgtatatatgcagaaagcattgtccccaatcttgaattgttagatattcatttaaggcaaacatttttgttttctttttccttactgaatgagagaagctggtaaggaaacggtgggatgtggccaggtgatag

SEQ ID NO: 84927 - DNA, 371 bp, Homo sapiens
cgctctggtcactggtgccacacttgcatttcttttgttaggaaactgttctgagccatggagctcccttaggcagaggcagcagctggcagacaggacacagccttcctggactgggcctatgaaatgaggcatgtctcattctgcactggcccatgaacccgtgcatctcacccctctcagtgttctgagattcagaattcttcctctgcttgagtgctgggactagcctgtgtctccactgtctggcccctctggttcaggcagtagctacactgggggatctgaagtgctccaaggatactgaggaagtactcaggtgggggtccttgaaaaaaccctcaggctgagcagtggaggctgtgctgtgc

SEQ ID NO: 84928 - DNA, 750 bp, Homo sapiens
ttttgcaaagagatatataacttgtttcaaatgtaagagcactttttaaaatatacttttacaatttattttgaaaagtaatacaatagaacaacctttggaaaatagggtaatgggattttaagtatgtttttctccacttctaatagaactattattagcacttctgagtatttcttctcaggcattctctcttaagatgtttttatataattataatcataaggcacagtctattctaattcctgatttgttttctttcagcacaaagaatgtaccacagtttttctaaccattttcatatctcattggtgaacttttaaggtttttcttatttgtggatgaatatctggtacatatatattcttccttcacttgaataatttctttaagaaagagttctagaagtgggattctaggtgaaagaatttgaattcttttatgactgttgataaaaattgctcaatccctttttttttggagctaaaatcactatttttaatcatggtaagcatgattaaacaaagtacacatggcataaaatgtaccattttaaccattttcaagtgtacagttcagtagcattaagtttgcttcaagtttacattgttttgcaaccatcaccattatccatttccagaacatttatcattttctaaaactgaaacttttacccattaaacaataacttcctgttcttccctctcccacagcccctggcaaccaccaatctactttctgtctctatga

SEQ ID NO: 84929 - DNA, 515 bp, Homo sapiens
ttaattaaaataagtcaaaaaaaatgaacagacatgccagcacgaccaagtatcagaggaaagccttcaatgtgaataatggtgaccaaaatgaccaaaaaaaaaaaaggtagctgggaacaggcagagattatgcaacaattagataaatttccaaaggctctgaaaaaagctatcatttataaccatggtacaactataaaacaattaaccaaggccaggcgcggtggctcatgcctgtaattacagcattttgggatgctgaggcataagaatcacttgaatccgggaggtggaggttgcagtgagccaagattccaacactgtactccagcctgggtgagagccagccttgtctcaaaaacagaaacaaaaacaattaactagttattgtttaaaaaaaagaaacatctgtattttatatgtatacacaaagttcttggagggtaaaaatacgatgcacaaaggaaaagctcaatagacaggctggacaataaagttcaggatatctccca

SEQ ID NO: 84930 - DNA, 1016 bp, Homo sapiens
gggggaggcttctccgaaagccgcgagggcagctcccgtgtgtccgctgtgcaaaccggtccttccgccaaaaacctgctgtctggcttttctcagtgcctccctggatggatgtttgggagagtttacgcgtggccttgtgggatcgctgtggcggactctcagctatcagagggctccatcactccatctgtaagtgatggcagctggtggcgagtcctgagcagggatgtgatcctgactgggccacgtgctggctgccctggtgacagaagcttgacgtcacaccagaccatgtgcctagtgaatgtgcacccaagagcctgagccacttgcccctgctcccaactattcccaggccaacaacctcttgtcaaacagcccggccaactctgcctggcacagggtgcaggctctagacgtggatggagcaggattgcatcctttcagttgtccacactgttggtcaaacagagtaaaagccatggccagcaactgtactaagtggactacatgttgcatctagcctgttcaccggaattccttctgacaaatatttgagccatcccctcctgctgactgtggacagcagagcgagcacgcaaggccacgttgcaggccatcgttgcaatgccacagctctggggctgaggccatggcccctcaaccgaacacgtatagatgacaagggtatgcacccgtgttaagccacggactggtctcaatctccttgagctacgtgaaactggcccggcggaggactccccaacagttgctaggggaattaacacggcagttgatgccatttgggcccccgtcaagacgttctggcattcctttaaccgggcggcaacccacccacgtgtcgccctatggtaacgtcggcttcttgcgccatgggagacatgaatcacacggtaggccccaccagccgggcgtcaaccactccaagtaggtcccggggtctcggagacacatacaccgtttgagagacgcgctctgcagcaagacacttg

SEQ ID NO: 84931 - DNA, 185 bp, Homo sapiens
gtcttttataataaactggtcaacataactacagtgtttgctgagttctgtgagtagctctatcaaattattgaacttgagggaggttatgggagtcccaaatttttaaacagtaaccccagtgtatagatgggcctatggaatttgtgactggcatctgcagtgaggatagtgttgtgggactg

SEQ ID NO: 84932 - DNA, 393 bp, Homo sapiens
cctcagcctcccgagtagctgggactacagacacccaccaccatgcccggctaattttttgtattttttagaagagacggggtttcaccatgttagccaggatggtcttgatctcctgaccttgtgatctgcccgcctcggcctcccacagtgctgggattacaggcgtaagccaccgcgccggacatattgtttgtgtttttctaataatagccatcctgaaaagtatgaggtgatttctcgtttacttttgatttggatttccttgacaattagtaacattgagcatttttccatgcagaagcctgttcacatgcttctgctcaaactattagcttcacatgccacctgggggaaaaagcaagtttctagcaaaggcctctaccactaacc

SEQ ID NO: 84933 - DNA, 1917 bp, Homo sapiens
atataaagaacttctataaatcaatagggaaaagaccaaaaaaagtcatagaaaagcaagccaatgatttgagtaggcaaattagagaagtggaaaccgaaatgtccaataaacaggtgaagagtcaagcttagcagctattagggaaatgcaagttaaaaccaactaccatccaggtgctgtggctcatgccacaaggttggttgagtgtaaattgaaacaatcattttggagagaaatttggcaatctcttgtaatattaaaagctctttgactcctagatatatatcctagagaagttccagcaaatgtgcacaaagacatataaaagatgcttactatttgttaatctggaagtaacacaggggtcattaataggggggtggacaaagaaagtgtatgtcactaatgaactagatctgtatgtaacagtattgtatcagtcaggtgtgccgcaataatgctgcatgacaaaacaccctaaaactgacttataacaacaggcatttaattttggctagtatgtctgcatcagctggcctgtattagtctgttttcacactggtgataaagacacacctgaaactggggggaaaaaaaaagatttaattggtcttacagttccacaaggttgaggaggtctcagaatcatggcaggaggcaaaaggcacttcttacatggcagcggcaagagaaaaatgaagaagcaaaagcagaaatccctgataaatccaacagatctcttgagacgtattcactatcacaagaatagcatgggaaagaccagcccccatgattcaattacctcccctggtccctcccacaacacaggggaattctgggagatacaattcaagttgagatttgggtgggggcacagccaaatcatatcatggggtttggccagtctagcccaggattggctcgacttggctcgggtcattttgtgattagtgtgctcctcacatttcaccttttctgggcccagtaggccatccaggacatgtgcaagccagcgacactatgggcagctctgggagccagtttatataccaactcctgatggtacgtccagcctgctgcccaggaaggaagccagtgctggcacctggaaggcgcctggcgtgtatgggagcaccaagagcatggggagatgcactgcagcaggcagcacagacctacagtctgttatcacagtctcgctctctgtaataagcaggttaataaggtaataaggaggttacattgctgtttgaatttgctttccttgactaagcatctcttcatgctcaaaagtcttttacatgtcttcttctgtgaattcttttgtgtcatttgctcatttatctacttgtatggtttttgccttgaagaaaatgtaaattttaacttagttaaatgtataaagttttatcttcatagcctctggatttctttttttctttcttcccctgagatagaccttccctattacatgataattttaaaaattctccaatttttttctagtacatttatagtttctttccattttgtatttgttttgctgctgggactctggacactgttcattgccctactcatctcttgcgttatgtatttggttagctatgtttatcatattcattttttttttttttttgagtcagtctcgctctgtcgcccaggccagaatgcaggagcacaatctctgctcactgtagcctcaacctcctgggctcaagtatttcccctacctcgccttcctgagtagctgggactacaggctcacacctctacacacactcgactactttttgtatttttagtggagacagggtttcactatgacgcccagcctggtctcgaactcctgggctcaagggatccgcccgccttggcttcccaaaatgctaggattacaggtgtgagaaactg

SEQ ID NO: 84934 - DNA, 1466 bp, Homo sapiens
atataaagaacttctataaatcaatagggaaaagaccaaaaaaagtcatagaaaagcaagccaatgatttgagtaggcaaattagagaagtggaaaccgaaatgtccaataaacaggtgaagagtcaagcttagcagctattagggaaatgcaagttaaaaccaactaccatccaggtgctgtggctcatgccacaaggttggttgagtgtaaattgaaacaatcattttggagagaaatttggcaatctcttgtaatattaaaagctctttgactcctagatatatatcctagagaagttccagcaaatgtgcacaaagacatataaaagatgcttactatttgttaatctggaagtaacacaggggtcattaataggggggtggacaaagaaagtgtatgtcactaatgaactagatctgtatgtaacagtattgtatcagtcaggtgtgccgcaataatgctgcatgacaaaacaccctaaaactgacttataacaacaggcatttaattttggctagtatgtctgcatcagctggcctgtattagtctgttttcacactggtgataaagacacacctgaaactggggggaaaaaaaaagatttaattggtcttacagttccacaaggttgaggaggtctcagaatcatggcaggaggcaaaaggcacttcttacatggcacaccaagagcatggggagatgcactgcagcaggcagcacagacctacagtctgttatcacagtctcgctctctgtaataagcaggttaataaggtaataaggaggttacattgctgtttgaatttgctttccttgactaagcatctcttcatgctcaaaagtcttttacatgtcttcttctgtgaattcttttgtgtcatttgctcatttatctacttgtatggtttttgccttgaagaaaatgtaaattttaacttagttaaatgtataaagttttatcttcatagcctctggatttctttttttctttcttcccctgagatagaccttccctattacatgataattttaaaaattctccaatttttttctagtacatttatagtttctttccattttgtatttgttttgctgctgggactctggacactgttcattgccctactcatctcttgcgttatgtatttggttagctatgtttatcatattcattttttttttttttttgagtcagtctcgctctgtcgcccaggccagaatgcaggagcacaatctctgctcactgtagcctcaacctcctgggctcaagtatttcccctacctcgccttcctgagtagctgggactacaggctcacacctctacacacactcgactactttttgtatttttagtggagacagggtttcactatgacgcccagcctggtctcgaactcctgggctcaagggatccgcccgccttggcttcccaaaatgctaggattacaggtgtgagaaactg

SEQ ID NO: 84935 - DNA, 422 bp, Homo sapiens
accatcagtagttccaaggctcttagttatacttccagattatatcacctcttctcccagaagtaactactatcaagaattttatgttaatcatatcctcgcctttatttatagctttgtgttttttttatagtacagtgtatgcggccatgtgctgcataacactgtttcagtcaagaatgaactgtttctacaatggtgatcccatgagattataatggagttgaaaaattcctgtcacctcgtggcattgtaacctcacagtgcagtacattagtcacatgtttgtggtgattctggtgtaaacaaatgactgtgctcccaaagtatacacaatacaagtatgtaccatacataatagttgataatgataataaacaactatattagtaggtttacatgtttactatagtgtactttta

SEQ ID NO: 84936 - DNA, 439 bp, Homo sapiens
cttgaattctaggcatgtgactgtgctcctagacatagacaacagctaatttgatggtaaaagacatactgaggaaagttatagtttatttttgttccccacagttatcaggaaaaccaaatcaaatttaacactgagaatacagaaagtttcaccacaattctctgatttagctattccttttttggttttctctaaggaagtagaacatatgacagtgaatactgcagctacttttcacttcctcttttatagccatatattactgtaagtatacttgcttaagttccaagtctcttgatttaaacacatgatttgcttgatttcatgaaggatattcaagcctaatagaagtaggagtatctgataatctgccttctgagtttctaggcctcttagagtttactattaatctagaagtagtaatcaggagccttgt

SEQ ID NO: 84937 - DNA, 532 bp, Homo sapiens
gggtttcaccgtgttatccaggatggtctcgatctcctgacctcgtgatctgccagcctcggcctcccaaatcacgctgagattacaggcgtgagccacggcgcccggcctcagcttcttaaaaacaatcgggttagagtgagcttttcacttggcaccacgtcaccagccgcatccggccaccgactcttctcccacaaatgtggacgtgccattgtgcggccgccctggagttggacatcgaggatgctctagatttttcaacattataaacggcaccatgaaggcgacttttcctgtaatactcgagtctttgttcctcatccctgatgatctccttagaatgaatgactaacaggtgtgacagctaagattctgggtgcgtctacccaaaattatcatctggggaggtcagagacggctccaccccctgccacagatggggagaccttccagctttgctcctgtggtcacggctgctcaggagcagaacttaccccggacccaggctcagaaaacaccatcaaatcac

SEQ ID NO: 84938 - DNA, 1755 bp, Homo sapiens
aaacaaggaaaaccggcctgactggggggtgaattcagcagggagtaaatctgatcggcatcaggtctgcggaaaggagctggtgagcacgacaccacccaggcattgcctggctctctccgcggcgggctaagttaaccgcgggtccaggagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgcagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaaagtcttgtttcaaaactgtctaaaattatgtgtgtgtgtgtgtgtgtgtgtgtgtgtgtgagagagagagagagagagagagagagagagagagagaattttaatgtattttcccaaaggactcatattttaaaatgtaggctatactgtaatcgtgattgaagcttggactaagaattttttccctttagatgtaaagaaagaatacagtatacaatattca

SEQ ID NO: 84939 - DNA, 580 bp, Homo sapiens
tatcttacttgttaggttgagaaagaaagaaggccagaaactatgggaagtaacttgattccgttggaattcttttgcataataaaatctgatatgtaatggatgacaaatgagataatatttacctgtttttcagcatgggtcaacaaaatacaagtactgatggctgctgcaagctttggccaaactaaaatcccccggggaaatgggccttattccgttggttgtacagacttaatgtttgatcacactaataaggtaatgctttgatttatacaacttatcctgatactctaatattgtctgtcgctatggaccactagaaggtgttcaaatgtgaccttgccctcacctgagaatgactcattttgcaatttgtattgtttcatatgaaggcttttactagtttggccattcctcaattctttgttattgtctgattaatttctctataaaccttatttttcacttccttaatacctgaagccaggctgcttgtattttcctttcactgagatagaatattgtttttctgtttctctttcatgactatcttcaatcaccacagcagcctaaaaag

SEQ ID NO: 84940 - DNA, 1810 bp, Homo sapiens
gacccaggacacagcccgcgcgcagccacccgcccgccgcctgccagagctgctcggcccgcagccagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgcagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaaagtcttgtttcaaaactgtctaaaattatgtgtgtgtgtgtgtgtgtgtgtgtgtgtgtgagagagagagagagagagagagagagagagagagagaattttaatgtattttcccaaaggactcatattttaaaatgtaggctatactgtaatcgtgattgaagcttggactaagaattttttccctttagatgtaaagaaagaatacagtatacaatattca

SEQ ID NO: 84941 - DNA, 372 bp, Homo sapiens
gagttacggtttcttcttctgtttccgtttcctctctctctactcactcctactttctcctgcatcaactttggtcaattaacatagacaagtgattcatctgtagagaggctcctagactccaagcagcccccttccttgttcattgtggctgtaggttttataaggaggtctgtggctccctggcatcaaaatatgaaaaataaaatctgtgcctgttccagcttcaatcctcctccaagccttagcttttcaacaaccctaccctttcaacttcagggatcatggagtcacagagactggacaactcctccaaatctagacaaagactttcttaagcgccctgagcccaggtgcatatcttcccatcag

SEQ ID NO: 84942 - DNA, 632 bp, Homo sapiens
ggaaattaacttggggtttagggtggacgttttttgccttattttgcttcttagtaaatgaaagtgaagcctgaataatgagaatattattaatccatctccatttttctactttaaaggcacagcatagattttggttccagttgttactactttaatgagagtaatgaatattccatgtgagggcagtgtgcatgaaagtgtgctgggaaagttctatggatctttgtgttttgtttcagttttgaggattaaatgcaagtttaatcctttaatgaatatataagtcggttgatgccctttcttgagaaagttatggttaaattgttgtgtcaaatcattgtatttcattctgtctccagtgtgggggtagcatagagaggtggtgggtagggctgggggtgaatatgtgtgtttttcttaagcgacgctagttttggaaaatgtaaggattccaaaggttaatgtggattaaaatgctgtctgccatgaactttagaaattgaaataaatgtggttggtaaaagaagaactgtgttttgattacacggaaatgcttttgtaggccttttctttcaggtgaagtaaacatcttaaaaataagcacaataaatatgtttctaagcacggtg

SEQ ID NO: 84943 - DNA, 495 bp, Homo sapiens
agtgggagcacttagattcggagcatggatagtccggagtccaaggtctctgggtgagcagacagtcggccaaaggccagcctggagtcaaagagaccagacccctgcttagattgccgttctctctccactcccggtagtggagagagaacgtaacccctttgtgaagtacttggtgtacttcaccattttatagatgggagaactgagtctcagactaaggaaactgttacatggctgataaatgactgacctggagttgaattcaggaccacctgattccaatcccttctcccttgagacactgacttccattcttttctggaccaaatcaagatcaaaggacccttttcacatcagcttctgctattggaactgagatttataaattcaatatgactatacaagctctctaggttaatggattaaccaaataagttaaaggcataggctgttaacccacttgcccactctcacacgcattctctctccacc

SEQ ID NO: 84944 - DNA, 420 bp, Homo sapiens
aacagaaaagcggtgatccccctaggtatatccaagcaaagtggtcaggggatagagtttatgtgagcctttaaggcatttggctcagggctggggcttgtttctttctgttttggtaacaacctagataattttatcagtgccaggaaatgttcaagaccccagtgtgggttcaagccttcagggtaaaacatgttgggtcacagagggatcaaaaggactctgtgatctttgggtcaagacacagaaataggggacagacactgggggaccctacagctttgataacttagttaaggtgatatacaccagttttccctattatacgactagcttactctttttcgctttgtaattaataaatatcttattggaacatattttgaaactaaactaaataaatatcctgtttttattcaa

SEQ ID NO: 84945 - DNA, 912 bp, Homo sapiens
gtccgaagttcactcctaggtgatgtacttaatacctgttagtaacattcattcaaacccagagttcttggttctaatttcctgagaacagggccttgccctagggcacagcccctcattgcatcccagcccttgttgggagggcagctacctatggtttgctgatagactaaactgtgccccccaaacaaatttatatgttgaagccctaacacccggtacctcagaatgtgaccttatttggagacggggcctttaaagaggtttcaaattaaattgagactattagggtgggtcctaatccagtctgaccagtgtctttgtaagaaggggagattaggacacagaaacaccaggtgcatgtgctcacaggggaaagaccgtgtgaagagcagtaagaggggagccatctgcaagcagaggaaaccatccctgctgcaccttgatcatggacttcagcctccagaactgtgagaaattatttctgttgtttaagccattcagtcagtggtattctgttatgtcaaaagaatacacattaccctgactgttgattgaaatgcctcttggcaatttggccattgtatttgcaaggaccactctttatgaaattgacacaaagaggggcttaagttagtgggaactctggacttacccagggactaccatgtaatcattacactggagaggttggcaggtctggatcaagcttaagattttttaaaaaattgttatacaggagtggcgtggtggctcacgcctgttaatcccagcactttgagaggccaaggtgggcagatcacttgaagtcaggagttcaagaccagcctggccaacatggtgaaaccccgtctctactaaaaaataaaaataacgagccgggcatgatggcacatacctgtcagctacttg

SEQ ID NO: 84946 - DNA, 850 bp, Homo sapiens
gtgactgggctccctgtgagtgacggtcacacaccctcccggcatcctgagccgtcgctgccgtgtcagtgatggcattgtgggtgagcaggtagtggtgtttgcattcctggccgccccgagtccagcgattgtcacacacatcccagcatcctgggccatcgctgttgtgacagtgatggcggtgtgggagagcaggggctgctgtgtccattcgtggctgccctcccccacctccattcccactaatcccggattagggctgacactccaagcccgctctcgcctggacagctacagcttagtgctccccctcctgcctctgccttgtcctgatatcactctgtcctacccagggaggagaccagttcttggcctgtcgcttagggattgagaagacactggtaataacttaatcatgtccagcattctgtctgaaaagtggaattttctgtccaattgagacaataactcctcccattccaagttttaccccacctttgtattttaagatggaaagaaaccctaaactcttctagccaagccccttctccagaaggggagactgaggcccgtgaactggaggaatttgccaaggtctgcgcattggtggctgcagcctgttccctggtgggatgcagtatcaacttggagacctaaatgtttcctttaaatgagagccagcgagaagagctcagagagtagagttgttaatgtgttatcccaaacagtggggctcgcaccttccaggatccaaggactggtcagcaccggaggagtcctcctgctctctgatgaccactgcagcagcactgactccccgtattgcaggggacctcggattcccacc

SEQ ID NO: 84947 - DNA, 2256 bp, Homo sapiens
cacggcaggcggggggccgggccctggtggtggaaggccaggcggtgagcctgcgctgccgagcggtgggtgaccccgagccggtggtgcactgggtggcacctgatgggcggctgctggggaactccagccggacccgggtccggggggacgggacgctggatgtgaccatcaccaccttgagggacagtggcaccttcacttgtatcgcctccaatgctgctggggaagcgacggcgcccgtggaggtgtgcgtggtacctctgcctctgatggcacccccgccggctgccccgccgcctctcaccgagcccggctcctctgacatcgccacgccgggcagaccaggtgccaacgattctgcggctgagcgtcggctcgtggcagccgagctcacctcgaactccgtgctcatccgctggccagcccagaggcctgtgcccggaatacgcatgtaccaggttcagtacaacagttccgttgatgactccctcgtctacaggatgatcccgtccaccagtcagaccttcctggtgaatgacctggcggcgggccgtgcctacgacttgtgcgtgctggcggtctacgacgacggggccacagcgctgccggcaacgcgagtggtgggctgtgtacagttcaccaccgctggggatccggcgccctgccgcccgctgagggcccatttcttgggcggcaccatgatcatcgccatcgggggcgtcatcgtcgcctcggtcctcgtcttcatcgttctgctcatgatccgctataaggtgtatggcgacggggacagccgccgcgtcaagggctccaggtcgctcccgcgggtcagccacgtgtgctcgcagaccaacggcgcaggcacaggcgcggcacaggccccggccctgccggcccaggaccactacgaggcgctgcgcgaggtggagtcccaggctgcccccgccgtcgccgtcgaggccaaggccatggaggccgagacggcatccgcggagccggaggtggtccttggacgttctctgggcggctcggccacctcgctgtgcctgctgccatccgaggaaacttccggggaggagtctcgggccgcggtgggccctcgaaggagccgatccggcgccctggagccaccaacctcggcgccccctactctagctctagttcctgggggagccgcggcccggccgaggccgcagcagcgctattcgttcgacggggactacggggcactattccagagccacagttacccgcgccgcgcccggcggacaaagcgccaccggtccacgctgcactccagcctgggcaacagagcgagactctgtctcagaaaaaaaaaaagaaatatctgacagtagaggacagattaaataaattatgatctgctatatcatgacataaaatacatttactagtgatactgatccatataattgagaaagcatttatgatgtattaccaaatgaagaaagtagatttaaaaaggtacatgtaatttgggcagaggtactttggagaaattaagaacacaggctctgcagtacaactttcagggtgtgattctgaactctgacagttactaacctcgcagtgtctttttcctcactggtgaaactggaatataaataccatgagatatggctatctcaattatcaagtaagataatctacataaaacatagtaatacataacaattactttacataagttagctgtttttattaaagatcactgacattacatatcccttaatccatttttagaaaagaaacatgaggctgctgttttcttatgctaaaatatgtgcttctcaatcagctatcaatatcatgaatgctaactaaaaataactttccaagcctgatgttaagcatgaatttatttgaatcagcagaattagcaaaaacgattctaagacacgtaagaaaatgttccctctttaccagcaactagggaaatagagacatgattctgcatcagaaatcaagtttaaagaatctaatctgagaagagataccaaatcaagaatattagcaagagactgaatcatgtgttctatgtgatatgggagattcgtgtaattatttcaaattgttgccatcttagtcatttcatatatttggatttcatataccttggatttgttacttgtacatataatcatggaaatgttacttgtgtatatttggaaggcatcagatatcactgattatcattctctgtcaaagaaacattaaaatcatagaaaatct

SEQ ID NO: 84948 - DNA, 132 bp, Homo sapiens
tcgaattcaagcttctaacgatgtacggggacatggccaacaacgaaggacttttctccctggtggcgaggaagctgagcagacccctgtgatgcctgtgacctcaattaaagcaattcctttgacctgtcc

SEQ ID NO: 84949 - DNA, 1753 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84950 - DNA, 1699 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84951 - DNA, 2775 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtccagttgactttagtccttgtttctaactgccaagtcatgtgctgagtagaggctcagtggttggggcccaatggttcatctaggacgggactagagaggtcagtctacaagcaatccattgaccacttacttggtgctgcacacaaatgttggtgctatgggacccaaagatgagcaattagtattccagtcttcattgcctgtgcttacaaaagaagacctcacttccctaaacatctagttatggcggctcaagcccgtacctgcctacagagaagtgtctgcagttactcactattagtttcctaagggggcactgctggctccttctctcccaggaatgggcttctcctattctttaactcttgccttctccctggagaggctaccaaaccctggcctctgccgctgttcaggctgccatgtgggtatagctgtttgctagactccactctggcctcaggggccagagaacagctgtccagcatttctgttcatcccagcaatccaaaaaaaaatttttttaagctacaaagatcactccattttcaaattcagactctgccacttattagctgtttctcattaggcaagttatataaccttgcagtgcctcactttcctcatctataaaatgagattaaaatagtctttttattaagagaattaaagtgaattgtggccaggcactgtggctcatgcctgtaatcccagcgctttgggaggctgaggcagacagattgcttgagctcagaagttcgagactggcctggggaacatgcaaaaaccctgtctgtattaaaaatacaaaaaaattagctaggtgtggcggcatatgcctgtggtcccagctactcaggaggctgaagtgggaggatggcttgagcccgggaggcggaggttgcaatgaactgagatcgcaccactgtgttccagacagagtgcgatgctgtctcgaaaaaagtaaaataataaataaataataaataaaataaaataaagtgaattgttacatgtaaagga

SEQ ID NO: 84952 - DNA, 2020 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtccaaaaaaaaaagagaagaataacaaaaaaaattatgggagcggctgggccactgagaagcttaacacaccattggagtgaggcgcagtgaaccagaaggattaataaataagagacaaagagcggacaccaagagacaccggacacggaaaaggagagagaaaaccgaacagaacaaaagcgcgggaaacacacagagtactagaaaaccaaaaaggagattgggaaaacaggagacataaacagagactcaacagagcgaaacagac

SEQ ID NO: 84953 - DNA, 1700 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatgttttctccctggtggcgaggaagctgagcagacccctgtgatgcctgtgacctcaattaaagcaattcctttgacctgtcc

SEQ ID NO: 84954 - DNA, 1735 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacaggtagagaaactggtgtctacttcttggcttttgaagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84955 - DNA, 791 bp, Homo sapiens
catttaatcgccgttttctgttcttggacatcaaagctggggcttaggcgctgtgctggggtcgcggcggcgcgggcgctgggggagaggagtgtggtcttcagcatagagtgagcttctagtgacacgagctggagggaaagaggaagtgcatcatgacggctcgtccaatggacaaggaacgtgtgaacagaggaaacctgtgccctttccctgggcatagctagaaagtgtcaagactccagactcatctctattctcaatgtggtgctggagcagaagcaatgctttgatggttgtttcacagcccagagtatcagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84956 - DNA, 661 bp, Homo sapiens
tgatatcccctcttctattttctgaaagagtttgagtattattagtataatttccttcttaaatgattgatagcatttaccagcgaagccaggtgaatctgaaatttttgtgcgagagaagactttattaaaaacagtatttctttaatggttacttggattttccgtttgttcttttgtctgttttgagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84957 - DNA, 1612 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84958 - DNA, 2533 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtccagttgactttagtccttgtttctaactgccaagtcatgtgctgagtagaggctcagtggttggggcccaatggttcatctaggacgggactagagaggtcagtctacaagcaatccattgaccacttacttggtgctgcacacaaatgttggtgctatgggacccaaagatgagcaattagtattccagtcttcattgcctgtgcttacaaaagaagacctcacttccctaaacatctagttatggcggctcaagcccgtacctgcctacagagaagtgtctgcagttactcactattagtttcctaagggggcactgctggctccttctctcccaggaatgggcttctcctattctttaactcttgccttctccctggagaggctaccaaaccctggcctctgccgctgttcaggctgccatgtgggtatagctgtttgctagactccactctggcctcaggggccagagaacagctgtccagcatttctgttcatcccagcaatccaaaaaaaaatttttttaagctacaaagatcactccattttcaaattcagactctgccacttattagctgtttctcattaggcaagttatataaccttgcagtgcctcactttcctcatctataaaatgagattaaaatagtctttttattaagagaattaaagtgaattgtggccaggcactgtggctcatgcctgtaatcccagcgctttgggaggctgaggcagacagattgcttgagctcagaagttcgagactggcctggggaacatgcaaaaaccctgtctgtattaaaaatacaaaaaaattagctaggtgtggcggcatatgcctgtggtcccagctactcaggaggctgaagtgggaggatggcttgagcccgggaggcggaggttgcaatgaactgagatcgcaccactgtgttccagacagagtgcgatgctgtctcgaaaaaagtaaaataataaataaataataaataaaataaaataaagtgaattgttacatgtaaagga

SEQ ID NO: 84959 - DNA, 1143 bp, Homo sapiens
catttaatcgccgttttctgttcttggacatcaaagctggggcttaggcgctgtgctggggtcgcggcggcgcgggcgctgggggagaggagtgtggtcttcagcatagagtgagcttctagtgacacgagctggagggaaagaggaagtgcatcatgacggctcgtccaatggacaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84960 - DNA, 971 bp, Homo sapiens
ctctctctctctctctctctccggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84961 - DNA, 2199 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtccaaaaaaaaaaaaaaaaaaaacaaaaaaaaaaaaaacaaaaaaaaaacgggggaggcacaataagaggggggggagggaaaaaaggagggagaagacggagagcagaggggaagaaagggagataagagaacagaattatataagagacacaaggggaaaaaattgggggagattaaaaataataggagagaaaaaaaattaaaaaaaacatgaggaaaaagagaataaaggaaattgagcagcagagagcgaacgacgcaaggacaaagaaaccgcgacagccggaaatagcgagtagcgaataggggacaagcatagagggggacgggcaagaacacgagaaagcgaagcaaacaagaagagagaacgaagggcaaagcaaaagaacagaggaaaaacgaggacgaaagaaacacagaaaagaaaaaaaagcaaagaaaagagac

SEQ ID NO: 84962 - DNA, 655 bp, Homo sapiens
cactctagaggatctgcgataacgagcgcgctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84963 - DNA, 1789 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacaggtagagaaactggtgtctacttcttggcttttgaagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84964 - DNA, 1709 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgatgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtcc

SEQ ID NO: 84965 - DNA, 1356 bp, Homo sapiens
caggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacaggtagagaaactggtgtctacttcttggcttttgaaggtacctgagtgatggttggcaaaagcaacagacagatagg

SEQ ID NO: 84966 - DNA, 4728 bp, Homo sapiens
atggccccctcggcctgggccatttgctggctgctagggggcctcctgctccatgggggtagctctggccccagccccggccccagtgtgccccgcctgcggctctcctaccgagacctcctgtctgccaaccgctctgccatctttctgggcccccagggctccctgaacctccaggccatgtacctagatgagtaccgagaccgcctctttctgggtggcctggacgccctctactctctgcggctggaccaggcatggccagatccccgggaggtcctgtggccaccgcagccaggacagagggaggagtgtgttcgaaagggaagagatcctttgacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccgggggcggtgccctcacgagcccagccgtccctttgccagcaccttcatagacggggagctgtacacgggtctcactgctgacttcctggggcgagaggccatgatcttccgaagtggaggtcctcggccagctctgcgttccgactctgaccagagtctcttgcacgacccccggtttgtgatggccgcccggatccctgagaactctgaccaggacaatgacaaggtgtacttcttcttctcggagacggtcccctcgcccgatggtggctcgaaccatgtcactgtcagccgcgtgggccgcgtctgcgtgaatgatgctgggggccagcgggtgctggtgaacaaatggagcactttcctcaaggccaggctggtctgctcggtgcccggccctggtggtgccgagacccactttgaccagctagaggatgtgttcctgctgtggcccaaggccgggaagagcctcgaggtgtacgcgctgttcagcaccgtcagtgccgtgttccagggcttcgccgtctgtgtgtaccacatggcagacatctgggaggttttcaacgggccctttgcccaccgagatgggcctcagcaccagtgggggccctatgggggcaaggtgcccttccctcgccctggcgtgtgccccagcaagatgaccgcacagccaggacggccttttggcagcaccaaggactacccagatgaggtgctgcagtttgcccgagcccaccccctcatgttctggcctgtgcggcctcgacatggccgccctgtccttgtcaagacccacctggcccagcagctacaccagatcgtggtggaccgcgtggaggcagaggatgggacctacgatgtcattttcctggggactgactcagggtctgtgctcaaagtcatcgctctccaggcagggggctcagctgaacctgaggaagtggttctggaggagctccaggtgtttaaggtgccaacacctatcaccgaaatggagatctctgtcaaaaggcaaatgctatacgtgggctctcggctgggtgtggcccagctgcggctgcaccaatgtgagacttacggcactgcctgtgcagagtgctgcctggcccgggacccatactgtgcctgggatggtgcctcctgtacccactaccgccccagccttggcaagcgccggttccgccggcaggacatccggcacggcaaccctgccctgcagtgcctgggccagagccaggaagaagaggcagtgggacttgtggcagccaccatggtctacggcacggagcacaatagcaccttcctggagtgcctgcccaagtctccccaggctgctgtgcgctggctcttgcagaggccaggggatgaggggcctgaccaggtgaagacggacgagcgagtcttgcacacggagcgggggctgctgttccgcaggcttagccgtttcgatgcgggcacctacacctgcaccactctggagcatggcttctcccagactgtggtccgcctggctctggtggtgattgtggcctcacagctggacaacctgttccctccggagccaaagccagaggagcccccagcccggggaggcctggcttccaccccacccaaggcctggtacaaggacatcctgcagctcattggcttcgccaacctgccccgggtggatgagtactgtgagcgcgtgtggtgcaggggcaccacggaatgctcaggctgcttccggagccggagccggggcaagcaggccaggggcaagagctgggcagggctggagctaggcaagaagatgaagagccgggtgcatgccgagcacaatcggacgccccgggaggtggaggccacgtagaagggggcagaggaggggtggtcaggatgggctggggggcccactagcagcccccagcatctcccacccacccagctagggcagaggggtcaggatgtctgtttgcctcttagagacaggtgtctctgcccccacaccgctactggggtctaatggaggggctgggttcttgaagcctgttccctgcccttctctgtgctcttagacccagctggagccagcaccctctggctgctggcagccccaagggatctgccatttgttctcagagatggcctggcttccgcaacacatttccgggtgtgcccagaggcaagagggttgggtggttctttcccagcctacagaacaatggccattctgagtgaccctcagagtgggtgtgtgggtgcgtctagggggtatcccggtagggggcctgcagggagccagagggtggaaatggcctctaagctagcaccccgtaagaagagcctacctgaccgacttggggagggaacacagaggtgttgggaaggtggagcaacaatgcacctcccctcctgtcgcgccgtgatatcttggtggctccctgccactgcccaccgcctcttctccatctgagaatcacggagaggtgtagataatctagaggcatagactgctagagcccccagggatctggggtggtcagggctcaggcttcactttgtaaaccaggtgggggcatctcacagcctgacttcccttccccaggccagggttgctgggatgcctgcccctcctgagaggaccccctccccattgtcaggctctccatgtccacgagcggggaggggtgggttctggggcattgttgtcccttgtgtctgtggactagagatagggtgggggagctggggaagggtgcaggcgggaagagtgggctgtctttcccagggtgatgcaagcatgccgcagccctggaggctgggaatgtggaggctctgtgagccctgcagccctcagaatcagggccagggatgcagaagattgagaggatatggagatggatagagggcaggagacccttaggatagattgtgggacccaggcaggaacaggtgtccacaagaactcaggatggcatcagttagctcagaagccacctggaagacccagtgtttccatctctggaatctctgttttatgctaaatggatttaggaagactgtttttcttttaagggggaaacaaggtagagaaaaggacgaagaagtgtaagtcccgctgattctcgggggtaaggctcggatggcaaggacgcgttctgcctgggcatgtaggggaggtgtttttgccatcaccagtttctcaggctggggagcacagaggggaggaggaggactaaatgaaaagttgttcccagcctgcacatgaacacattcatgacacacaaaactggctggaaggagataagagcactgggtttgagattccctccattaaaacaaccaagacaaagaaaggaggggaaaaaaagataaaaagcaagccagggttccctgccctattgaaactcaaacccagactgccttgggttttatctttcccttacccctggcacctccagagaactgggacctgaaatagtccctccgttctcccctttgaccatgtaataaatgaaccagaagcactgagattaacctatcaacgccctgagaagccttccagcctgcggtgctgtctgctgggaggtcagctggtcaaggcagaggaggagaggaggaaaggatgggggctgaagagcagaagggaggggagacagaggggattaaagaggggaggagagagtgcagagctccaggaaagggtatcagagctgcagccagctctgccctctaccctagggaggccagaaagacacaaacagccctccgggcctttacgctggactctggcttggcaggctccaggcagggtcctctgggaagttactctagaaaacgaagggaggaggagcacaagatcctcagcaacgaacacctgcacttagaaaaagtggacagcttctgccaaccacaccctacccatggtactgtatgctattaactcctggaaacgccccgtaaatgcgagttgtttttgtatttgtgtgttgagatgggccttgtggtttctctgtactcagagcacatttcttgtaattactattgttatttttattgtcatgactgcccctgagctctggtgagaaaagctgaatttacaaggaaagggatgaagttaatatttgcatcacataattatatcattactgtgtatctgtgtattgtactaaatggactgatgctgcgcacatgagctgaaaatgaagagccctcccatccattccatgagaaagaaggtcaccctgag

SEQ ID NO: 84967 - DNA, 342 bp, Homo sapiens
gccaggtgggaggctctgagcctcccgtcccacctgtccccaggagccatggtccgaaagccttccagcaccatgtggatggaaacattttccagatacctcctgtctgccaaccgctctgccatctttctgggcccccagggctccctgaacctccaggccatgtacctagatgagtaccgagaccgcctctttctgggtggcctggacgccctctactctctgcggctggaccaggcatggccagatccccgggaggtcctgtggccaccgcagccaggacagagggaggagtgtgttcgaaagggaagagatcctttggtgagtgctgtcgggagggat

SEQ ID NO: 84968 - DNA, 543 bp, Homo sapiens
  misc_feature (24)..(25): n is a, c, g, or t
ttcatcgtgtcgcccccgcggtanntggatatgtcgaaccacgccgtcgcgcaaacagccctccgggcctttacgctggactctggcttggcaggctccaggcagggtcctctgggaagttactctagaaaacgaagggaggaggagcacaagatcctcagcaacgaacacctgcacttagaaaaagtggacagcttctgccaaccacaccctacccatggtactgtatgctattaactcctggaaacgccccgtaaatgcgagttgtttttgtatttgtgtgttgagatgggccttgtggtttctctgtactcagagcacatttcttgtaattactattgttatttttattgtcatgactgcccctgagctctggtgagaaaagctgaatttacaaggaaagggatgaagttaatatttgcatcacataattatatcattactgtgtatctgtgtattgtactaaatggactgatgctgcgcacatgagctgaaaatgaagagccctcccatccattccatgagaaagaaggtcaccctgag

SEQ ID NO: 84969 - DNA, 3195 bp, Homo sapiens
gaaagaaatctggtgcctgggggtccctgtgttcacccctagagtttgttttaaaatttttaattgaagcatgtgaagtgtacgtgcagaaaagtgggaacatgatagtgtatggcttggtggattttcacaaactgaacatacctgtgtaatcagcatctagacccagacccagagcatcacaaatatcccccatcctgggcttttcccagaggagatgggggcttctgaagatggacttacctgggacctgccccccatgagccaggacggtccccccacagtcagcctgtgcaaaggccccgtggccaggggtggaggagaatatgtgggtgtggacaggatgggagactgtggcctgaacaggagattttattatatctggagaccctgagagaccctgagacctggggcaccatggctggccaggtcagaagcatcctgactgcagaggtccgtgcagccacaccctcttccctgccagcaagttgtctgcggctcatcggaggcccctccgcctggagccttctatggacgtgatatgcctgtatctgtttttaattttcattcttcacttaggggaagtgaaatcgctcagagatgagatcctttaattgaaaacgaagtgtaacggaatctagtgtctttctaatgtggtaaaattctccatcaacatcacagtcagctggcagctgaacttcagaatctcacttacagcaggcgacacgggggtacaccgatgggtcacactgggtctgggggctccctggagctcctcctgcgtgtggtctggttaggagttgagttgtttgctccagggttattctcctcctcgagtcacagtcacacgaatacctgccttctctggctttcctgctatacacatattcacatggcgctcaagaagttaggctcatggcaacgtgtgtctttctctggacaactggcccagtttacagtgaaatggagaatttcaggtctccacgtctgcccaggaaagaacttcagctgactccacggggatctggaaatccacgaccaatcccgatcggctcttattagctccccgctccacaagacacctgtgctttggaaatccaccaccaatcccgatcggctcttattagctccccgctccacaagacacctgtgatctggaaatctaccaccaatcccgatcggctcttattagctccccgctccacaagacacctgtgacatcctccagggccacaggagcacgtgctgaccagttttcccttccagttcctgcacaaaaagtgtccagagggctgtttgcaaacactagtgcactttgtagcttttcaccctctgtcccagggaatctaggagagatgaggcccgtcagagtcaagagatgtcatccccccagggtctccaaggcatttccacactattggtggcacctggaggacatgcaccaaggcttgccagagccaacaggaagtgagcccagagcatggcacatgagcatcacccgctgatggtggcctgctgtgcctggtgccaacaggggcatcccggcccgtacccctccagacaggaagcatgggtttgcccacagacctgtcgggtgctcctgtgagtggcctccagatgtctttgtgcataggcacaagtgggccagggctggagggaggtgggaaacctcatcatccggtgggccctgccaatcttaacccagaacccttaggtattcctggcagtagccatgacattggagcaccttcctctccagccagaggctgacctgagggccactgtcctcagatgacaccacccaggagcaccctaggtgaggggtgagggcccccttatgtgaacctcttgcctcttcctttctcccatcagagtggttggatggagccattggcctccttttcttcagcgggcccttcaacctctctgcaccatgttgtctggctgaggagctactagaaaagctgagtggagtctcctttccaacaggatgatgcatttgctcaattctcagggctggaatgagccggctggtcccccagaaagctggagtggggtacagagttcagttttcctctctgtttacagctccttgacagtcccacgcccatctggagtgggagctgggagtcagtgttggagaagaaacaacaaaagccaattagaaccactatttttaaaaagtgcttactgtgcacagatactcttcaagcactggacgtggattctctctctagccctcagcacccctgcggtaggagtgccgcctctacccacttgtgatggggtacagaggcacttgctcttctgcatggtgttcaataggctgggagttttatttatctcttcaaactttgtacaagagctcatggcttgtcttgggctttcgtcattaaaccaaaggaaatggaagccattcccctgttgctctccttagtcttggtcatcagaacctcacttggtaccatatagatcaaaagctttgtaaccacaggaaaaaataaactcttccatcccttaaagaatagaatagtttgtccctctcatgggaattgggctgtatgtatattgttcttcctccttagaatttagagatacaagagttctacttagaacttttcatggacacaatttccacaacctttcagatgctgatgtagagctattgggaaagaacttccaaactcaggaagtttgcagagagcagacagctagagataactcgggacccagagttggtcgacagatgttagatgtatcctagcttttagctataaaccactcaaagattcagcccccagatcccacagtcagaactgaatctgcgttgttgggaagccagcagtggccttgggaaggaagccatggctgtggttcagagagggtgggctggcaagccacttccggggaaaactccttccgccccaggtttcttcttctcttaaggagagattgttctcaccaacccgctgccttcatgctgccttcaaagctagatcatgtttgccttgcttagagaattactgcaaatcagccccagtgcttggcgatgcatttacagatttctaggccctcagggttttgtagagtgtgagccctggtgggcagggttggggggtctgtcttctgctggatgctgcttgtaatccatttggtgtacagaatcaacaataaataatatacatgtaaaaaagg

SEQ ID NO: 84970 - DNA, 2921 bp, Homo sapiens
gaaagaaatctggtgcctgggggtccctgtgttcacccctagagtttgttttaaaatttttaattgaagcatgtgaagtgtacgtgcagaaaagtgggaacatgatagtgtatggcttggtggattttcacaaactgaacatacctgtgtaatcagcatctagacccagacccagagcatcacaaatatcccccatcctgggcttttcccagaggagatgggggcttctgaagatggacttacctgggacctgccccccatgagccaggacggtccccccacagtcagcctgtgcaaaggccccgtggccaggggtggaggagaatatgtgggtgtggacaggatgggagactgtggcctgaacaggagattttattatatctggagaccctgagagaccctgagacctggggcaccatggctggccaggtcagaagcatcctgactgcagaggtccgtgcagccacaccctcttccctgccagcaagttgtctgcggctcatcggaggcccctccgcctggagccttctatggacgtgatatgcctgtatctgtttttaattttcattcttcacttaggggaagtgaaatcgctcagagatgagatcctttaattgaaaacgaagtgtaacggaatctagtgtctttctaatgtggtaaaattctccatcaacatcacagtcagctggcagctgaacttcagaatctcacttacagcaggcgacacgggggtacaccgatgggtcacactgggtctgggggctccctggagctcctcctgcgtgtggtctggttaggagttgagttgtttgctccagggttattctcctcctcgagtcacagtcacacgaatacctgccttctctggctttcctgctatacacatattcacatggcgctcaagaagttaggctcatggcaacgtgtgtctttctctggacaactggcccagtttacagtgaaatggagaatttcaggtctccacgtctgcccaggaaagaacttcagctgactccacggggatctggaaatccacgaccaatcccgatcggctcttattagctccccgctccacaagacacctgtgctttggaaatccaccaccaatcccgatcggctcttattagctccccgctccacaagacacctgtgatctggaaatctaccaccaatcccgatcggctcttattagctccccgctccacaagacacctgtgacatcctccagggccacaggagcacgtgctgaccagttttcccttccagttcctgcacaaaaagtgtccagagggctgtttgcaaacactagtgcactttgtagcttttcaccctctgtcccagggaatctaggagagatgaggcccgtcagagtcaagagatgtcatccccccagggtctccaaggcatttccacactattggtggcacctggaggacatgcaccaaggcttgccagagccaacaggaagtgagcccagagcatggcacatgagcatcacccgctgatggtggcctgctgtgcctggtgccaacaggggcatcccggcccgtacccctccagacaggaagcatgggtttgcccacagacctgtcgggtgctcctgtgagtggcctccagatgtctttgtgcataggcacaagtgggccagggctggagggaggtgggaaacctcatcatccggtgggccctgccaatcttaacccagaacccttaggtattcctggcagtagccatgacattggagcaccttcctctccagccagaggctgacctgagggccactgtcctcagatgacaccacccaggagcaccctaggtgaggggtgagggcccccttatgtgaacctcttgcctcttcctttctcccatcagagtggttggatggagccattggcctccttttcttcagcgggcccttcaacctctctgcaccatgttgtctggctgaggagctactagaaaagctgagtggagtctcctttccaacaggatgatgcatttgctcaattctcagggctggaatgagccggctggtcccccagaaagctggagtggggtacagagttcagttttcctctctgtttacagctccttgacagtcccacgcccatctggagtgggagctgggagtcagtgttggagaagaaacaacaaaagccaattagaaccactatttttaaaaagtgcttactgtgcacagatactcttcaagcactggacgtggattctctctctagccctcagcacccctgcggtaggagtgccgcctctacccacttgtgatggggtacagaggcacttgctcttctgcatggtgttcaataggctgggagttttatttatctcttcaaactttgtacaagagctcatggcttgtcttgggctttcgtcattaaaccaaaggaaatggaagccattcccctgttgctctccttagtcttggtcatcagaacctcacttggtaccatatagatcaaaagctttgtaaccacaggaaaaaataaactcttccatcccttaaagaatagaatagtttgtccctctcatgggaattgggctgtatgtatattgttcttcctccttagaatttagagatacaagagttctacttagaacttttcatggacacaatttccacaacctttcagatgctgatcttctcaggtgttattctcattttaaagaacaagttaaacaaaatactgtgtgatcaagtaaacgcaagccagtctttctgttgccattattccacagctgatgggacgcagatcagtcttgctcccatcaggattgttttaaattctaaactataagtttgttcagaggggcttttgcaatgatagcagaaaactgtacaaatgtacagttagttatagaggttcttgttgaaatgaacttaccatctgatgggagaagacgcg

SEQ ID NO: 84971 - DNA, 2310 bp, Homo sapiens
attctataaggtcccaaatactctttttcaacccatgaacagtaagaatttgtgaattctgataatgaaaaaagttttcctccaggtatgtttgtttcacattcagtcctaaagccttgagctatgtgtacttccctcacacaggaacaccagctgtcctgtctgtgctctgcctgcgcccaaaactcaatattttctctcagcacagaagtcaaaaatgagatatgccccttataaaaccccttcgattcctgagaaaacataataaagccatatgttgcttccttgttggggctcctccacaatgctcccaacacctgtgacccctaggaagacagggagcaaggtggatctggccaggagtcacaggatatacacccattctggagctttcctctgttgttctagaagatgttatttggattagttggggctgggagcaggggatatatgattttgtggaaaaggtatcagataatcaaatcaggtctgcctctgctatagccagtgtgctgctgcattaaaagggaacaaaaggaaggtgcaacgtaagagcagacacaacctgagatgcccttgagatttaggagaacaggagggcgccctttctgttgtgacctgactcttaaaagaaatcttctaaaagaattctttaatttggtaatgagttgaagtccagggtaatggaagctctagggcagagaacaaaagaattgcaaaatgtattcagcaccaaacaatgctaaaccaagaaacatccaatcacaaaactaggaagtttggcaagaagtggttagagaaatctctgggcttttccatgggcagggtcgacagactctcttttcagtgatttctggctctgagaaacctctttactcactagaaaagaactttatttaaatggccaattttgttcctcagaaaaagaaattaaaaaaaaagaaaaataggatactgaagacagaaccatgtgacttggtgacaaacaaaaggaggggtgcactagaatttcaataggctccctaattccatagaaaaagcaaagcaacccaatgcctcctgagcctgcagtgcatgaagagagtgcttgagctgacccagccaccaggccttctggggctagacataacttcccactggaacagcagcagcctctttcccctctttgtgttttcatgaagaaaacggctgttctcttaggtagccaggaaatagattacatggggcaaactttcaaaagcaatctctaccctggtgctcaggctacatacagaggcagaaaaggggcacggaagagcccttgctcttgagagagagtattttcatattcccaagggctttccgtgtagagttgctatttctgatatcacttaaacctttacaagaaaaaaggctgtggtgactcagtgttcctataaattcagaatgtggaaactactaatccaaagcatcatttctagcactgagtatcaagacgatcagcctgaccaaaatattgcaaagagttttctaagtctctgaagatttttttctccttgaacactgagtctatagcagtcagcaatgtaccttagccgatccctgggaatggttatggaacagtagggcttgtttccatcctttttagagtgaagagatagaaaattagggctacctagtgtgggttctttttcagaactatgtattttctcctcactgcatgatgggtaaaaatgccctgggttgaaacaagaaacattatctttccacaccactgactaaaacacctgccagtggtttctttaggctccaccttttgctccgtaaactgtagactttcagactgaaatctaatcttaagtgacctcaattaaggtattttcacaaaaggctacttatagtgtagcattattgccttaaatcagaaagccctgggaagaggataaaagatatagaaatgagaaggctctgaagttataggcatttcttgctgtttaatagttacattatcacaaaaacaagccctattcatgattgaggactatggaaatagtgacttcttgaggaggcaccaaactttcctagaactgggtactctcagatagtggctgctatttcctattctatttcagtgacgtaggttggggctgaatgtaaaatagacatcatattactaaatagaatcctataaaatgcaatcacaggtgcccgggagtactagttttaaacatttccttaacaaggagaacaatccagaaaaagctttctttctctatacaggtatatctctaaactttttttcctcagttttagagaacatctgttttatct

SEQ ID NO: 84972 - DNA, 2213 bp, Homo sapiens
attctataaggtcccaaatactctttttcaacccatgaacagtaagaatttgtgaattctgataatgaaaaaagttttcctccaggtatgtttgtttcacattcagtcctaaagccttgagctatgtgtacttccctcacacaggaacaccagctgtcctgtctgtgctctgcctgcgcccaaaactcaatattttctctcagcacagaagtcaaaaatgagatatgccccttataaaaccccttcgattcctgagaaaacataataaagccatatgttgcttccttgttggggctcctccacaatgctcccaacacctgtgacccctaggaagacagggagcaaggtggatctggccaggagtcacaggatatacacccattctggagctttcctctgttgttctagaagatgttatttggattagttggggctgggagcaggggatatatgattttgtggaaaaggtatcagataatcaaatcaggtctgcctctgctatagccagtgtgctgctgcattaaaagggaacaaaaggaaggtgcaacgtaagagcagacacaacctgagatgcccttgagatttaggagaacaggagggcgccctttctgttgtgacctgactcttaaaagaaatcttctaaaagaattctttaatttggtaatgagttgaagtccagggtaatggaagctctagggcagagaacaaaagaattgcaaaatgtattcagcaccaaacaatgctaaaccaagaaacatccaatcacaaaactaggaagtttggcaagaagtggttagagaaatctctgggcttttccatgggcagggtcgacagactctcttttcagtgatttctggctctgagaaacctctttactcactagaaaagaactttatttaaatggccaattttgttcctcagaaaaagaaattaaaaaaaaagaaaaataggatactgaagacagaaccatgtgacttggtgacaaacaaaaggaggggtgcactagaatttcaataggctccctaattccatagaaaaagcaaagcaacccaatgcctcctgagcctgcagtgcatgaagagagtgcttgagctgacccagccaccaggccttctggggctagacataacttcccactggaacagcagcagcctctttcccctctttgtgttttcatgaagaaaacggctgttctcttaggtagccaggaaatagattacatggggcaaactttcaaaagcaatctctaccctggtgctcaggctacatacagaggcagaaaaggggcacggaagagcccttgctcttgagagagagtattttcatattcccaagggctttccgtgtagagttgctatttctgatatcacttaaacctttacaagaaaaaaggctgtggtgactcagtgttcctataaattcagaatgtggaaactactaatccaaagcatcatttctagcactgagtatcaagacgatcagcctgaccaaaatattgcaaagagttttctaagtctctgaagatttttttctccttgaacactgagtctatagcagtcagcaatgtaccttagccgatccctgggaatggttatggaacagtagggcttgtttccatcctttttagagtgaagagatagaaaattagggctacctagtgtgggttctttttcagaactatgtattttctcctcactgcatgatgggtaaaaatgccctgggttgaaacaagaaacattatctttccacaccactgactaaaacacctgccagtggtttctttaggctccaccttttgctccgtaaactgtagactttcagactgaaatctaatcttaagtgacctcaattaaggtattttcacaaaaggctacttatagtgtagcattattgccttaaatcagaaagccctgggaagaggataaaagatatagaaatgagaaggctctgaagttataggcatttcttgctgtttaatagttacattatcacaaaaacaagccctattcatgattgaggactatggaaatagtgacttcttgaggaggcaccaaactttcctagaactgggtactctcagatagtggctgctatttcctattctatttcagtgacgtaggttggggctgaatgtaaaatagacatcatattactaaatagaatcctataaaatgcaatcacagtacccagatccggggataaggatcctgcta

SEQ ID NO: 84973 - DNA, 969 bp, Homo sapiens
aaaaaatcttcagagacttagaaaactcttgcaatatttggtcaggctgatcgtcttgatactcagtgttcctataaattcagaatgtggaaactactaatccaaagcatcatttctagcactgagtatcaagacgatcagcctgaccaaaatattgcaaagagttttctaagtctctgaagatttttttctccttgaacactgagtctatagcagtcagcaatgtaccttagccgatccctgggaatggttatggaacagtagggcttgtttccatcctttttagagtgaagagatagaaaattagggctacctagtgtgggttctttttcagaactatgtattttctcctcactgcatgatgggtaaaaatgccctgggttgaaacaagaaacattatctttccacaccactgactaaaacacctgccagtggtttctttaggctccaccttttgctccgtaaactgtagactttcagactgaaatctaatcttaagtgacctcaattaaggtattttcacaaaaggctacttatagtgtagcattattgccttaaatcagaaagccctgggaagaggataaaagatatagaaatgagaaggctctgaagttataggcatttcttgctgtttaatagttacattatcacaaaaacaagccctattcatgattgaggactatggaaatagtgacttcttgaggaggcaccaaactttcctagaactgggtactctcagatagtggctgctatttcctattctatttcagtgacgtaggttggggctgaatgtaaaatagacatcatattactaaatagaatcctataaaatgcaatcacaggtgcccgggagtactagttttaaacatttccttaacaaggagaacaatccagaaaaagctttctttctctatacaggtatatctctaaactttttttcctcagttttagagaacatctgttttatct

SEQ ID NO: 84974 - DNA, 332 bp, Homo sapiens
ttaattgcaatcaattaattgcaaattgaaaagtggggcagcaaggtaacctgacaagagctctggaaaagttggtgactgctttctagctgggtgcccttgtgcaagttacttaacatctctgagctacagttccctcttctataaaagggatcgtctctataccacatgattggcctgtataataaatatggtagcctagctcagtaccttccttcctcagcaaatacagagggtcccctagatgaccagcgtttcgatcatttccaatcatttctggttttttttttttttttttttttttgagacagagtctcgctctatcacccagc

SEQ ID NO: 84975 - DNA, 423 bp, Homo sapiens
gaaggcttagaaaggggtcacaggctggagagcttcatggactgcatcccaccatgaaggaaatggaaacttggcttttccattctcaggttacaagggaagaaactttcatgatggtgttgataaagaatattctgactgaataagttggggccaatttggggttgggtctcagggaaatgaagaggctgtaagagcccaaatctttcccttcacgtggcccccagagtctttaaactctcctacttcttcaaggcccaagccccttccttcaactcatcttggatcacacgtgaacaaagtaacaaacatttattaagaatttgtattcacagcctggcacagtggctcacgcctgtaatcccagcacttcggggaggccgaggctggtggatcacctgaggtcaggagttcgagatcagc

SEQ ID NO: 84976 - DNA, 468 bp, Homo sapiens
ggaagatgaaaggttataaaagaccaacagttttgaccacatagaacaaaatttctgtaaggcaaaggacacttataaatacacttaccaagcttaataggggattttaatttatttactgtcatttcataacttatatgcttggtcctatttgtatttatttttgagacagggtcttgctctgttgcccagactgagtgcagtggcacaatcatggcttactgcagcctcgaccttctgggctgaggcaatcctcccatctcagtcccttaagtagctggaatcacaggcatgggcctggctaatttatttattttttgtagagataaggtcccactaccacccacctcagcctctcaaagtgctgggattacaggcctgagccacagtgcctggccttgacttcatttcatattgaacttttctctgttttttctattacaccatatggattacgtcttcgttgct

SEQ ID NO: 84977 - DNA, 423 bp, Homo sapiens
acacaccttgctctgcagagtgatctgtcttggcttttatccaaaaggaagatgaaatgcaatgtcttcgtatcatactgatactctagaaattaacttggattcatctttagcataacaaattgaatcataccaaaagcatctgccttaggtttttatttaaatgttaagcacagtaaaaccaaccattttaatggctcaagaaacaagaaagacacaaaatccaataatttaagcaacgaagggttacgatgctggttaagtagtttcctctatataaaagacaattctccacgtgtagaacagaaatcgtaacacattcctgctagaaaacaacttctgcagaggtgaaatggttatctagaagaatcgtttgaaacatacgtatgcataccttttcataaagtctttttatttaacaaa

SEQ ID NO: 84978 - DNA, 447 bp, Homo sapiens
gagaacttaccatatgcatagcactgtgcaaagaaacttatgcatatcatctgcatatctattcctacacacatcgtttatatctatgaccctttaaggcagggaaaattatgactcccattttacagataaggaagcttaacttaagaaagactaagtaatgcacagaaggtcacccagctgtgctctttcccactatctgatccgacttttctgcagacaaaaaaagacttggagggaagcccacggagagtggtggtttattctggcaggattaggaaggaccttaattctcctttttgtgggtcttattccaaattgtgtacaggactctagctactctcgtgtgtgtgtgtgtgtgtgtgtgtgtgtgtgtgttttctgattaccaaagtcatgttgcttattaaaaactcattatttttcagattaaaaactataatactg

SEQ ID NO: 84979 - DNA, 451 bp, Homo sapiens
ccttaaatttgaccagacgtggtggctcatccctgtaatcccaaaactttgggaggccaaggtgggcagtttgcttgagcctgggaggttgaggctgcaaaaccgagatggcaccctgcactacagcctgggccacagagcaagaccctgtctcaaacaaacaaactttatgattttgaggaaacctaggataattatctttaagacttgggagtagaggatgattaaaaagtgtaaactatgagaggtaaaagattgataaataaaagttcacattaggaacgtctgctcatcaaagacactataaagagagtgaaaagacaagatatgagatggaaaaagtattttttctttttcttttctttttgtttttttttgagacagggtcttgctctgtcactcaggctggagtgcagtgttgcagtcatagctcatctctacctcctggtct

SEQ ID NO: 84980 - DNA, 117 bp, Homo sapiens
agttgatccacccgcctcagtctcccaaagtgctgagatcaccacccccagccctattttttaaaagcctaatataccttataattaggtttcagtgaatgtttaagaaaaaattag

SEQ ID NO: 84981 - DNA, 333 bp, Homo sapiens
ctgggtcaaaatccccgcacatctattgtttcggagccaaagcaccaccaccagcaacccctgcgcacaacccggggctctccagcaccgctgttctgaatgccaagtgcccagcacggggtctggcacagtttccttaataaaatgtcctcttctcgtctccaggatgaaactcaggatccggaaggcagccttacaccctctccagacaggctccgttaggggatgaaagagcgggattacggtcccgaagctcagctgcacttggaagcactcggagtccccaaaccctgggcgacttccccatcggcgctccctggagaggactcctac

SEQ ID NO: 84982 - DNA, 105 bp, Homo sapiens
aaaatacaaataaattcaatcagtcttgatccttccttaatttccgaggaggaaataacaaaacttaggagaggaaatacgtaataaacacaatcaaaatgatca

SEQ ID NO: 84983 - DNA, 791 bp, Homo sapiens
aacagctcagcaggaccaggaattccccaagccccagccacccgaggcccaggctcaggggctccaagtcttagacacaacacaagggccctggggttgccatccagccccactttcctgggatgcatgtggctcgagaaattctagatggccctattttatttttcccctcaaaaacatttgtctagatcataaattccccattcctggaggcctcagacatggtatcaatgccaattggtctcaggtattttgggagctgtgtcacctgctagcttcggaaggcattcaagtttgttgtttccagctctggcttatctatcagggtcccaggccagtgtttaccaatgcagctcaccccatgcactctggccgagattctgatgcattcggggcagaggggcatccaagactctagttttctgagcacaggtcgggttttgagccagcaggtttgaactccttaaatcatctcttcagactgggcatttgtttccttgctggctttgtagaaagggcttggaggcatggacggcctggtagcctgcctgtctgcagaggccaggcagagcttatggctggactccccgctctgtggcatcacaggcaggaatgaaaagtgttcgtggtgcatcgcatgcgaccgaggggaaagctgctttcgcgacagagaccgcagactcagtcttcaatgtcatgtgacccagggctactccattcatctcaagcgactcaaaactgccacatctgtggctttcccctggacctagaggggccaggtcagttaaggc

SEQ ID NO: 84984 - DNA, 400 bp, Homo sapiens
aatatattcccccctcgtttttttgtttagtaatcctgtatgtaactaatctttttatctgtgttgctactccctctgctgcacagaagtcatctttattttgctgaaactctgactcctgtttcagtccatcaccctctgatggatgccctcttctccctgcttgtgttgcagcacaccagttcaggatacactctgtctaaatgccctccttatgcctctctggttctgactcttcatgttggaccatcctctcactttatactgtcatatcccacaccaggccactgctttgtggtcatgtcctccttaccctttttctggctctgactctgcctgctggtctgctcccttgtgtggatgtcctctttacccacctcaggctttgtcattccacatc

SEQ ID NO: 84985 - DNA, 407 bp, Homo sapiens
ctgacctgttcccttgttctagctctgggatagcccagtgcaaacttactactgcaacccggttgtcctctccatggcctgcagctgttcacccaaggagtgcctgagcatccctttcttggaggaactacaaagagactcgctcaaggacttcctgtcagcagcagaaatgctgagtcatcagtattctgttacagttcattgaaagcagtgctgacagtggtgcggccagatggacaatagtgagagctccagggccccagctcagtgctgcacacaatgggtgacaccaaagaaaagcttttattaaaataatacagtctataatgaagaaattaaattttacaaaacttcaacccactctccagatgattaaatgaattattaggaatatttcttttccaaaa

SEQ ID NO: 84986 - DNA, 1914 bp, Homo sapiens
  misc_feature (110)..(110): n is a, c, g, or t
  misc_feature (205)..(205): n is a, c, g, or t
  misc_feature (1246)..(1247): n is a, c, g, or t
  misc_feature (1252)..(1252): n is a, c, g, or t
  misc_feature (1264)..(1264): n is a, c, g, or t
  misc_feature (1270)..(1270): n is a, c, g, or t
  misc_feature (1328)..(1328): n is a, c, g, or t
  misc_feature (1354)..(1354): n is a, c, g, or t
  misc_feature (1369)..(1369): n is a, c, g, or t
  misc_feature (1706)..(1706): n is a, c, g, or t
gatgccctgcaatgcctcaggactctccagaatgttttcaccagcaaaaaggccctcagcagatgcagcctctcgaccttgaactttctagcctccaaaatggactatcngtactgaaacccagcaagctgaaatcagcaaaacaagatggtcttgctaacttgaggaagctgtagcagctggaagctccagagaggagggggcncagagtctgcacatcaatggggagacgtcattctggctgcattatgaatggatggtttggaggaagaatgtggatagctaaacaagaaggagaatagaaagaaactactcttaagactattgcaatatccaggtgcaatgtgctttgtttctgactgcagactataatgtttattcctattgggggcagagcaagatttcagtttcttttctcagcaacaagaaaatactctgtctgaaatcaagcaacttctgggaagaccaagagtgatggaaactagagttacaaagcaaaaaccctacatcctgaatgcccagcccggtcaatgaaatttttctgtctcatttatcagctaacttggtcctcttcccctgggaacaaaactgagaagggttaagagataatgtggaaacaaactccccagcacttgcctaagagggcagctgtgtacccagaccttctttcctctatgtcattgtactagaaagagagagttccatactctttaatctgaatagttggcactcacttaaaaaagaatgcagcctgattcctctctgcccctctagctatttccagaaagttgttcatgggatgaattggtaagtaaagaattcagacactggttctgattaagggatcttataaatgatttataacctttgggaacatcaaagacagcactcataagccaggcaagctaaggggtgctcaggagtaaaatgcacctccccatctcacaaatccattgttttgatgaaaggataagaggcagttggcctgggaaggtgaaaaggcaggaaaagagtgggaagtcagctcctaggataataaccacatccacaggcattgtctcctttcacatatttacagcttttctttcttatctttccacacctctatattcagttatgtatgacctactagcaatttacagctgctttaaatgcatacatttcaggtagggtgtggtgacttatgcctgtaatcccagcgcttcgggaggctgaggtgggtggatcacttgaggtcaggagttcnngatcngcctggccaacntggcanaaccccatctctactaaaaatacaaaaattagccagtcttggtggtgcacagctgtantcccagctactcggggggctgaggcnggagaatggcttgancccaggaggcagaggttgcagtgaggtgagatcacaccactgtactccagtctgggcaacagaaagagactccatctcaaacaaacaaacaaacaaataaataaataaatgcatacattgtatcagaaattatctcccatattgatgagtcttccatgggcatctaatttaaatatttttttctgaaaagcaaaaggtgctctattatgttgctggtgagagtgcaaaatggtatagcctctaaagagattaatgtaacaataactgttagaaccatatatgcaatcaccctttgacctagcaacctcacttctaggaattcatcttgaagacatanctctctatatgtaggcaaaatggaagctattcaatgttacattgttagtaatagcaagttactgtctatttttgtatctttcaaatacatgtctatttatgtgaaaggataaactgtggtttatccacaaaatgaatttttatgaagttgaaaaaagaatgagtgacatgtccatgaactgtcaggagtgatttccagaacgtatttt

SEQ ID NO: 84987 - DNA, 1816 bp, Homo sapiens
  misc_feature (1148)..(1149): n is a, c, g, or t
  misc_feature (1154)..(1154): n is a, c, g, or t
  misc_feature (1166)..(1166): n is a, c, g, or t
  misc_feature (1172)..(1172): n is a, c, g, or t
  misc_feature (1230)..(1230): n is a, c, g, or t
  misc_feature (1256)..(1256): n is a, c, g, or t
  misc_feature (1271)..(1271): n is a, c, g, or t
  misc_feature (1608)..(1608): n is a, c, g, or t
gatgccctgcaatgcctcaggactctccagaatgttttcaccagcaaaaaggccctcagcagatgcagcctctcgaccttgaactttctagcctccaaaatgagacgtcattctggctgcattatgaatggatggtttggaggaagaatgtggatagctaaacaagaaggagaatagaaagaaactactcttaagactattgcaatatccagtgttatctcaggaccaaggaattaatggtgcaatgtgctttgtttctgactgcagactataatgtttattcctattgggggcagagcaagatttcagtttcttttctcagcaacaagaaaatactctgtctgaaatcaagcaacttctgggaagaccaagagtgatggaaactagagttacaaagcaaaaaccctacatcctgaatgcccagcccggtcaatgaaatttttctgtctcatttatcagctaacttggtcctcttcccctgggaacaaaactgagaagggttaagagataatgtggaaacaaactccccagcacttgcctaagagggcagctgtgtacccagaccttctttcctctatgtcattgtactagaaagagagagttccatactctttaatctgaatagttggcactcacttaaaaaagaatgcagcctgattcctctctgcccctctagctatttccagaaagttgttcatgggatgaattggtaagtaaagaattcagacactggttctgattaagggatcttataaatgatttataacctttgggaacatcaaagacagcactcataagccaggcaagctaaggggtgctcaggagtaaaatgcacctccccatctcacaaatccattgttttgatgaaaggataagaggcagttggcctgggaaggtgaaaaggcaggaaaagagtgggaagtcagctcctaggataataaccacatccacaggcattgtctcctttcacatatttacagcttttctttcttatctttccacacctctatattcagttatgtatgacctactagcaatttacagctgctttaaatgcatacatttcaggtagggtgtggtgacttatgcctgtaatcccagcgcttcgggaggctgaggtgggtggatcacttgaggtcaggagttcnngatcngcctggccaacntggcanaaccccatctctactaaaaatacaaaaattagccagtcttggtggtgcacagctgtantcccagctactcggggggctgaggcnggagaatggcttgancccaggaggcagaggttgcagtgaggtgagatcacaccactgtactccagtctgggcaacagaaagagactccatctcaaacaaacaaacaaacaaataaataaataaatgcatacattgtatcagaaattatctcccatattgatgagtcttccatgggcatctaatttaaatatttttttctgaaaagcaaaaggtgctctattatgttgctggtgagagtgcaaaatggtatagcctctaaagagattaatgtaacaataactgttagaaccatatatgcaatcaccctttgacctagcaacctcacttctaggaattcatcttgaagacatanctctctatatgtaggcaaaatggaagctattcaatgttacattgttagtaatagcaagttactgtctatttttgtatctttcaaatacatgtctatttatgtgaaaggataaactgtggtttatccacaaaatgaatttttatgaagttgaaaaaagaatgagtgacatgtccatgaactgtcaggagtgatttccagaacgtatttt

SEQ ID NO: 84988 - DNA, 408 bp, Homo sapiens
tcttctgataacaatttaaattgcatctaaaatgtcatctatttacagttatttttgaatacttcatttgcccaattaatgaacaagcatttatttattcatttgtttatttattttgagatagggtctcaagcggttgcccagactagactgcagtgagccaagatggcgccactgcactccagcctgggcaacaaagcgagactctgtctcaaaattagataaataaataaataaataaatgaagatgcctaaccctagctggcccgtcccttggctattaggtgccgcatgacccttgtaagtacctacacccaggcccctggcctcgttggcctcatctggcacagtttctccccctcctcttctccagatggcctgcacgtgcgctgtctatgtgcgcacctg

SEQ ID NO: 84989 - DNA, 236 bp, Homo sapiens
gccacctgcctcccgcactgaggctgccagtgctcagctctgtccctccctgcccgacagtggaagtgatagagggcaccctgcagtgcccggaatctggacgtatgttccccatcagccgcgggatccccaacatgctgctgagtgaagaggaaactgagagttgattgtgccaggcgccagtttttcttgttatgattgtgtgtatttttgttgacatataccgtttccgaatt

SEQ ID NO: 84990 - DNA, 216 bp, Homo sapiens
catgcaccacctgctgctggaggtggaagtgatagagggcaccctgcagtgcccggaatctggacgtatgttccccatcagccgcgggatccccaacatgctgctgagtgaagaggaaactgagagttgattgtgccgcgcagggggttttccagactcaagcacttgtgtaatcgacggtcatgtacaacgcctgtgaccgcatgtcatggctcg

SEQ ID NO: 84991 - DNA, 706 bp, Homo sapiens
gcaagacagaggcaggactgagaagacgagaggtgggcttcgttcctgagaatatccaggagtccaagagatctaaattggaagatggccttccaatttaggtcagtttccaattaagaaggccaggtttttatgaagcaatatttgtcaagaattcaactatcaacttgctggtcctctacttcccgaaactctccagcctacatttcttcctcttcttcggtttctaaactcaaactgactttggaatgaaagggagcagctgctgaggtaggaaggtcggaggtggccctccaaaagcctcttttctggaagctccgctgccaagggctcgactggagtcccaggacatattcagaggccgccagacccctgcatggaggcccctcccttgcagctcctggttaccatgattgaatgatgtcctgcagctccgagcctcagccacctatgttgtcaaggtttcctctgtgaaagcatccaaaaactctgccagcaccttcttctttccttttttgttttcctaccagggccaggccaggctctgctggccatttccgattaagctcctcagaaggcatagagccactcacactcagaattatttaaaataacactagactgcaaatgccctaaatatccatcagaaataaatggatgcataacattgggtgaaagaagccatacacaaaggtgtatactatat

SEQ ID NO: 84992 - DNA, 240 bp, Homo sapiens
tccaggcaatatccatttgagcaatagcattgttatgaaagcacagtgtttgtgcaaatagatctgattcaaaatcccaaccttcttagtcatgttctcttaagttaaataatgatttaccttatttataaaatggtatagtattgccttgctcaaagggaatgaaaattaaatgaaataataaagctctcacactacctaggagacctttccttttatttcatatgttgtcaaaattag

SEQ ID NO: 84993 - DNA, 270 bp, Homo sapiens
aagcctcggtgacagagtgagactttctctcaaaaaattaaaaacaaaaccaaaaaccatacttatgtcatgggctgtacaaaaatgggcaccaggctgaatttggccaagaagcatagtttgctactccatttagaatacgacagaatgggccaggtgtggtggctcacacctgtaatcccagcactttgggggccgaggtgggcggatcacttgaggtcaggagttcgagagcagcatggccaacatggtgaaactccatctctactt

SEQ ID NO: 84994 - DNA, 220 bp, Homo sapiens
tagagacaggatttcaccatgttagccaggctggtcttgaactcttgacctgaagtgatccacccaccttggcctcccaaaatgctgggattacaggtgtgagccaccgggctgagccccatctctagtacttttatcatcccaaactgaaacatcatacctattaaacaaaaattccccaccttccaaccccaagaccatggtaaccactcttctactt

SEQ ID NO: 84995 - DNA, 533 bp, Homo sapiens
  misc_feature (3)..(4): n is a, c, g, or t
  misc_feature (6)..(6): n is a, c, g, or t
  misc_feature (15)..(15): n is a, c, g, or t
  misc_feature (129)..(129): n is a, c, g, or t
tcnntntttgccagnaatgttggaagtggacatttcattggcctggcagggtcaggtgctgctacgggcatttctgtatcagcttatgaacttaatggcttgttttctgtgctgatgttggcctggatnttcctacccatctacattgctgtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgtgctacagtttcgccgcggttggtgggatggaaggactgaaggagaagtacttcttggccctggctagcaaccggagtgagaacagcagctgc

SEQ ID NO: 84996 - DNA, 844 bp, Homo sapiens
  misc_feature (440)..(440): n is a, c, g, or t
gcctttcacagagacacgtgcatgctgtaaaaatgagtctcggagacctgtgttaactcttgtggtcgtctttgaacccagatctgcctgctgtcatggtcttgttttaatcactgctgaggaggggagggggcacaactggatgaagtgatgacatgatgtttaggagacacagaactaggaagcatcgcaaaggccttctttttccactctcctcttccttccagaatccattccccatgttaaaaaaggaaatttgaaggccagcacaggtgaaccactcagcgagtaagagactacaccagaggtggagttcaggccaggctgcctcagggcgcagagggaaatccaaatgggtaccttgttgtgagctgggggccaagtcctgactgtgttttcttgagcagggcttgttttctgtgctgatgttggcctggatnttcctacccatctacattgctgtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgtgctacagtttcgccgcggttggtgggatggaaggactgaaggagaagtacttcttggccctggctagcaaccggagtgagaacagcagctgc

SEQ ID NO: 84997 - DNA, 402 bp, Homo sapiens
aaagggccaggctgctgcacttgggacaccttgagacacagcttcctgcatcctagctgcttcagctgaaacagccatggggtcaagtggctccagtaaggcttgtgctgcataagccttacatcccctggcttatgtctagagggcatgagcagtaagccttggggtccgtgtagtgttaattttgcaggcttgcagaatgctagagccatggaggtgtgtgttactccactgagatttcaacgtatgtatgaaaaaccctataggcccaggcagagacttgttgcaggggcagagccactgcagagaccctctgctagggcaaggccaagcaaaaatttgggttaggtctactgcagagtctccactaaggcaatgcctagtggagcttcaggattaggg

SEQ ID NO: 84998 - DNA, 962 bp, Homo sapiens
ataagagctacaggagcatcttttgttatatgtttccccccctagttcctgaaatagctctagagaaatacaggtgaataacatcctttgttattcatatcaagcccctatcaaccataccccagtttctatttatgaagtggcttttgggaagtccctaaagacaggagtggggaaaggctggttgtcagggggatgggttgaaactttcatcttccccccttgacctccagggagggatgagtggctgaaaattgtgtaaaatcaacaatggccagtgatttaatcaaccatgcctatgtaatgaagccacccgataagccttaactggaactttttggagagcctccaggctggtgaagacattgaggtgctcagaaggtggtattccagagagagcacagaatctctgttccccttcccacattcattttgctatgcatctctcccatctggctgttcttgagaggtatccgtttataataaactggtaacctagtaagtaaactgttaccctgagttctgtgagccattctagcaaattatcaaacctaaagagttcatggatacgtgcaatttacagatgcacagtcagaagcacagatgacaatctgggcttgccattggcatttgaagtgtgttgggaggcagtcttacaggaatgagcccttatcctgtggggtctatgctaataacagacagttgtcagcattgcttggtgtcgaaaacccacattgttggtgtcagaagtattgtcagtaggatagggaaaacagtttgttttctttttttagtggtctttggtcatctttaagagcagggcttctcaaagtgtggtccttgaaccagcatcacctgtaccacgtaagaacttatgagaaatgttcattcttgggccccaacaaagaattaaaaattctgagggtgtgaacggggtctgagtttcagcacaacttcccgac

SEQ ID NO: 84999 - DNA, 462 bp, Homo sapiens
caacaacactgatgaatctagaggacattattaggttaagtgaattaagtcaggtgcaaaaagaaatatactgcaggatgtcacttacatgtggaatctaaaaaagttgaacccatagaaaaagcgaatagaatggtggttaccaggaggcagtgggatggggaatgaggaaagattggctaaagggtacaaagtttcagctggacaggaggaaggaattctgaagatcttctgtatagtgtggtgaccatagttaataataatacactgttatactcaaaaacggctaagagagtagattttaaatgttctcaccagaaaaaaaaatgataactatatgtggttatagatatgtcaaacagcttgatttaataattctacaatgtatacatatatcaaaacatcaccctgtaccccataagtatatacaataaattttaaaaataagaataatcattcatg

SEQ ID NO: 85000 - DNA, 3390 bp, Homo sapiens
  misc_feature (1800)..(1800): n is a, c, g, or t
  misc_feature (2062)..(2062): n is a, c, g, or t
  misc_feature (2158)..(2158): n is a, c, g, or t
  misc_feature (2610)..(2610): n is a, c, g, or t
  misc_feature (2889)..(2889): n is a, c, g, or t
ttttttatcccacttctttcatcctaaatgttgataaagataataaatacaggcagcttataatagctatttgaacgtattatcaaataaggtattttcctgttaactacacttctgtatagtttttaagcagaatttcaatcaagaagacactatttttctatatctctttagattactttttgatttttttaaacactgtttatacaagtttttatcaaacttccaacagataatgggtactgcctctcataaatcttccaaagggacaatggaaactgggcccagttgaataaagccatattcatttgttttggaacgcagagttctctgcatgtagattgcatttagcattctgtctagtgtatccatctgtagttttgcttttttcagaataaaaccttgacagtaattttgaacctgttactttatttctttttgcatgtattgctttaaaaaggccgaagtatagtattctcttcccctttttaagttttatgaaatcaatgttaaattgatattagtgccacttaatatttgacacctgctatgcctaatgaacttgaagtagtaaagggagcagcaggggccagccattcatattatgcaagataactggagaacgagcagactatgattagagctttagactagtgggttctaacctctttataagagcaaattcattatttatatgtgcatatgtgttaccttttcctttttcctctggatttataggtatttgagtttcaagaattttcttgagattatattatagaagtcattaagatggggaatcaatctctaggtatcagtggggcggggaatgtcactctcctggtgattcttgtacatgtttcttcttcccatttccggccatttttcccacctgacattttctccctgctccttatattacatagttctttatgatctttctcctgtgttttgtattccttctctgagagagaggggctccatctttgttggggataatcatagattggcccttggaaagtggattggaaaatttgaaggtggtgctcatttgtgtttaaacaattatttgctatcatatttagcagtatgctttgctggtttttagattgaacctatgcagacagttagctggagcctctaaagaagaaactttttattcttaagtgactgactgcttagtaatctacataacaaatgaaccattttgcttcagagacgtgaaataggcatctataaatgaatagtttttgaaactaaagttgttaagacaaagttcatcttttcacagtagggtttctccagaaaaccctctttactctattgaaatgcagctagttgaactaggaaagcatattccaataataggcccatgcaattagcctttagtataatggaatgaatggtggaattttttgtgcattgtcatcatcagttggtgttagtcccaaaccacataatagctagaaaccttgattgggagacacaaaggtttcttattcatgggcatgctttaattcttgaaactagtaaaatgttagactcttaaatcttaacacttttttgataactgtctactgctggtaagattaagatatggtgcttcggaattatgtcattattttgagtgagaagaaatgtcgaggaactcttcatttagcaccatatccaagccaaacctcgtatagaaattacacagtggtgtgctggtgaatattgaacaaccaccctgggggggggataaagccctgatttgtaatgtttgctgatttctgaggtataaatactctatcatggctggtntcaggctactagtgttatgttgctgaagttgggaaaaaagtgtataatcagctggcttgaattaatctcagctatcaaatattcaggattttacagcctgactttttttccagcctgtattttaataatctgcttattcttgtctttatctttgtcctttgttttgaaaaaattggtcttcctgaggtataatttatatgcagtaaaattcagcaattttaagtgtatacatttgatgagttttgacacatgtatacctcgncacaatgatgatattccattaacctttctatacacagttgccagattaattttcctaaaattgtgctttgcatccgtcatctacctcggcataaanccttcactggctatgtactgttcataggataaagtacaaaatgctgtggtctggctctctaccgtcttgctttttgtctacttatctgcttttatctaccacaacccggctacatgaacctcttattgcaataaaactgatcaactggttctaggcacagttgctgcatctgtgcctttgctgtcagctgtaccctgcctatgatattccttggacatcatattccttcttgactgcttggcctttccttaaagtctggctcaagccccattttcttacacgatccaggctttactgattacttctgcatcccgacagctgtcataccgcttgttttggcacttaactatcgcaacttgtattgaaattccagaggtgttttttggagtcatttgatcttacccaacaaagttgtaaactatgatggggtaggaaacgtacaacggagtttntagcactttgctcaaaaaaaaacaagaacaccccctaataaatggcttttgatgatgataaacctttaagcagctcttccaactcagtgagtcgcaaattcagtaacactactggggagaatagtactctgttgtaccattgacgtagagactgaaggtttggtctgtcccagagcatagatgtgtagtaatgtctctcaaaactagtattagtcattaaagtgcacattggagattttatctctgccttgaaaattcatccaaaggtagttagcttcntggactttggacttttggcacggattaagcgtttaaagtaggtctccaaagaaacttctttgtttctctcaaccagctttattgcactttttgaagtactggtaagaggtcaggagggtgtatctcattggtttccttcctgtcccaggaagccatgttacggtattctgaaagaactttttctttttcagtaactttactataagcaaatttttttttctttttaaaacttgaattttctctgtaagacattgcatacttgttgaaagcagacattaaatgataacctaacaaatacttaacttaattctagatgcctatctgtttctcaggataccttgtaggttcctcttctcttaaatactggctttactcagggctgggcgcgtgactcacaactgtaatcccagcactttgggaggctgatgtgggtggatcacatgaggccaggagttcgagaccagcctggccaacatggtgaaaccctgcctctactaaaaa

SEQ ID NO: 85001 - DNA, 3011 bp, Homo sapiens
  misc_feature (1421)..(1421): n is a, c, g, or t
  misc_feature (1683)..(1683): n is a, c, g, or t
  misc_feature (1779)..(1779): n is a, c, g, or t
  misc_feature (2231)..(2231): n is a, c, g, or t
  misc_feature (2510)..(2510): n is a, c, g, or t
tccggggagctgtctgtggtgttaggtgtcactaaaactcactggaatgagtgccacactgggtatccaaatgctgttggtcatcacaggcaggtgagagctcactgcaacctcagcctcccaaagtgctaagattacaggcgtgagccaccactcccggcccatttttctctttttgaagggttcttatttctactcttccagggcaattagaagcaaaaggaaaagacccttggactggagtctggtagaaagaatgctcagtgagcaaacctggggctctgaaccgtccccttgtatgtttttcatggccttgcagctcactccttggagctgtggttctttgaggtgtaggtcagaaattcacggggtgcttcatcaaagtgtgcatgtctgatgaatacctaccccctgcctgcccctctctaggtatcagtggggcggggaatgtcactctcctggtgattcttgtacatgtttcttcttcccatttccggccatttttcccacctgacattttctccctgctccttatattacatagttctttatgatctttctcctgtgttttgtattccttctctgagagagaggggctccatctttgttggggataatcatagattggcccttggaaagtggattggaaaatttgaaggtggtgctcatttgtgtttaaacaattatttgctatcatatttagcagtatgctttgctggtttttagattgaacctatgcagacagttagctggagcctctaaagaagaaactttttattcttaagtgactgactgcttagtaatctacataacaaatgaaccattttgcttcagagacgtgaaataggcatctataaatgaatagtttttgaaactaaagttgttaagacaaagttcatcttttcacagtagggtttctccagaaaaccctctttactctattgaaatgcagctagttgaactaggaaagcatattccaataataggcccatgcaattagcctttagtataatggaatgaatggtggaattttttgtgcattgtcatcatcagttggtgttagtcccaaaccacataatagctagaaaccttgattgggagacacaaaggtttcttattcatgggcatgctttaattcttgaaactagtaaaatgttagactcttaaatcttaacacttttttgataactgtctactgctggtaagattaagatatggtgcttcggaattatgtcattattttgagtgagaagaaatgtcgaggaactcttcatttagcaccatatccaagccaaacctcgtatagaaattacacagtggtgtgctggtgaatattgaacaaccaccctgggggggggataaagccctgatttgtaatgtttgctgatttctgaggtataaatactctatcatggctggtntcaggctactagtgttatgttgctgaagttgggaaaaaagtgtataatcagctggcttgaattaatctcagctatcaaatattcaggattttacagcctgactttttttccagcctgtattttaataatctgcttattcttgtctttatctttgtcctttgttttgaaaaaattggtcttcctgaggtataatttatatgcagtaaaattcagcaattttaagtgtatacatttgatgagttttgacacatgtatacctcgncacaatgatgatattccattaacctttctatacacagttgccagattaattttcctaaaattgtgctttgcatccgtcatctacctcggcataaanccttcactggctatgtactgttcataggataaagtacaaaatgctgtggtctggctctctaccgtcttgctttttgtctacttatctgcttttatctaccacaacccggctacatgaacctcttattgcaataaaactgatcaactggttctaggcacagttgctgcatctgtgcctttgctgtcagctgtaccctgcctatgatattccttggacatcatattccttcttgactgcttggcctttccttaaagtctggctcaagccccattttcttacacgatccaggctttactgattacttctgcatcccgacagctgtcataccgcttgttttggcacttaactatcgcaacttgtattgaaattccagaggtgttttttggagtcatttgatcttacccaacaaagttgtaaactatgatggggtaggaaacgtacaacggagtttntagcactttgctcaaaaaaaaacaagaacaccccctaataaatggcttttgatgatgataaacctttaagcagctcttccaactcagtgagtcgcaaattcagtaacactactggggagaatagtactctgttgtaccattgacgtagagactgaaggtttggtctgtcccagagcatagatgtgtagtaatgtctctcaaaactagtattagtcattaaagtgcacattggagattttatctctgccttgaaaattcatccaaaggtagttagcttcntggactttggacttttggcacggattaagcgtttaaagtaggtctccaaagaaacttctttgtttctctcaaccagctttattgcactttttgaagtactggtaagaggtcaggagggtgtatctcattggtttccttcctgtcccaggaagccatgttacggtattctgaaagaactttttctttttcagtaactttactataagcaaatttttttttctttttaaaacttgaattttctctgtaagacattgcatacttgttgaaagcagacattaaatgataacctaacaaatacttaacttaattctagatgcctatctgtttctcaggataccttgtaggttcctcttctcttaaatactggctttactcagggctgggcgcgtgactcacaactgtaatcccagcactttgggaggctgatgtgggtggatcacatgaggccaggagttcgagaccagcctggccaacatggtgaaaccctgcctctactaaaaa

SEQ ID NO: 85002 - DNA, 211 bp, Homo sapiens
tgtatgtgtgaacagctgccaccccccacacacacaccgacacagttttccgcctacccttccctattccccacaaaaatcttgcaggtagaattagactgcttttggtgaacagttaagttccttttctactcttgaacaatcgcagatcttactgtgcagtctgttttgctgaaagtggaaagtccccgtttgtggacagctcagttca

SEQ ID NO: 85003 - DNA, 650 bp, Homo sapiens
ttgaggaagttctgttgctggtgaggaaattctgttgagttctgtaggaatttttatagcttgttttgcattcagttctatcaacaagccagcagcaactcaaagggaagcctccttctggcatatcaatcacacaggcacataggatcatatagcatataggatcagtcccaagaagaactatggggtgggggagaggtttttcttccacttcttggattcagtgactttgagatggacctcttttttcctgtggacaaaatgtcatcacaccaacatcttattgcccatgctcttcaccttgtctatgttttggaatgggaccatgcttaaataaaattgcttctttccatgataatgcattttggggctgaggaaactatatgccttttaagtaatccttgctttgccctagcctgctctgcccctccaaagtccggcctcagctcatagtttagaaggcattagttttaagctgaggagtattagaaagtaatctttatggtaaatggtttttccctaaaggaggtggcctactgataagtgagagaataatatccattgggccatcttgccacctaggggaacccatttgctttgaaaataagaaacatctctttcagcaggcggtgattttcttcaaggatttt

SEQ ID NO: 85004 - DNA, 430 bp, Homo sapiens
acaattcaattgttttagtatattcatagagttgttcagcaatcaccatagcgtgtctagtatatggattgtttttagagccaggaagctggaagagatcaactagagagagagtgtagatagggaagtaagtctagtaagatagagcagcaagtacagatatagaagaggtccagagagaaggctatggtattatgaaatctctatttggtctctgtcccatttcctggcatactacttcaaaaatccttgggtcttcaaggtgataagtgtcattttgtatgctaatgagttgactgatggttggcatcccctgggtagcctaaggatgggggctggtcactggaaagaataaggcaggactagaggttgtgactttccgccctaccatctaacctctggggaagggagaagagctgaaggggtaaac

SEQ ID NO: 85005 - DNA, 416 bp, Homo sapiens
gtttcaaccttcttttgtatctcaatgaccttccttgccatccagattctgaattctatgtctgacgtttcagccatttcaatctggttagattccattgcgggggcactaatgtgattgtttggaggtaagaagacactctggctttcagtgtggccagagttcttgcactgggtctttctcatcttcaaggggtgatgatcctttatctatttggaattgctatcttttaaatggagattttagtttgtattgtcattattgcccttgaggatttggctgtggcacaacatgggtatagctgaaagactatatttctggatgcttttactgggcaaggttcagtttcacactcctggactgtgttctctaaccctggagtactggttctgggtcagtggtttcatccccttctt

SEQ ID NO: 85006 - DNA, 414 bp, Homo sapiens
tttttaagtgactctggcatcctgagccctaagaaacctttgcacacactcaggtcatgaagatattcttctcatcttcttccagaagcctcacggttttctaattttgaaaataggtctgggcggggcccgctgggtgcagttgctcacacctgtaatcccagcactttgggaggctgaggcaggcggattgcatgaggtgaggagttcaagaccagcctggccaacatcatgaaactccatctctacaaaaaatacaaaaattagctgggcctggtggaatgttcccgtagtcctagctactcagggggctgaggtggaaggcttgcttcagcctggaaggtagaggctgcagtgagaagagatcaccccactgcactccagcctgggtgacagaacgagactgtctcaaaa

SEQ ID NO: 85007 - DNA, 1268 bp, Homo sapiens
atttcctttctttttaaaccataaattagtttaaactgaaagtacgaggctggaagaaatattagtaaattatttggaatatagaatgtttactctttctttttatgttgtcttaatgattctgtgagattgttccggctcaaacagaagcttttctttggggaaggtgatttgtgggagactctagtgtattttaaattagcattttaatccattcttgacattcagttagtccagatctgccccataatttgctttagtaaagtcactttatggatttttggctatgttttagtttgtgtgtataaaagttctaagaaaacatttttgctattttaagtatgtaagggaagagaggagtgtttttaactttttatagttgatgactttagggtagcacaaacaaaactcctttgtatctaacttttctcaatcctctcttgaggtgctttactaatgggaatgatttctgtatgttcccttggtaccaagaggtactatgcaaagtaacctattacaccaagttacttgctttgctttcctctctatgatgtgataatacagtaaaagctttcttacccagcatagtgggagagtggagattaattaaaattgttaattaagagttaattcctattgacccaggtgatatttctcttctgatttccctccccttcccttctcttatcttaccactgtgaaaacagcatattgttaatctcgttgtcgtccagtattctgctttgtgattaggtcttttgatgtacagtggtctagtggagtcaagattcgcattgggttttctaaaattccagttgataaaagttccagataacacagctttcctgtatatagatcactattgggcaggtcagcaaagatctcttacagtgtaataataatctatgatgcttcatttagcagaaactctgcttaaaagaatcttcataatagtaagtttaggttttaaaaacttgtttcataaatatacatatatcctctctagtagtctggccaaaagaacagattttgttattgataatttgtagctggtaattttccacattttctatccactgtaatttttatgttgtcactgaagtgcctgcccagtactgtatattacagtctctcacaaacactgggaaaagggactgtcatcatcttgagtactctgtgtgtatatatatatatatagatagatagatttttttttttttttgagacagagtctctaatgtcacccaggctggagtacagtggcacaa

SEQ ID NO: 85008 - DNA, 716 bp, Homo sapiens
atttcctttctttttaaaccataaattagtttaaactgaaagtacgaggctggaagaaatattagtaaattatttggaatatagaatgtttactctttctttttatgttgtcttaatgattctgtgagattgttccggctcaaacagaagcttttctttggggaaggtgatttgtgggagactctagtgtattttaaattagcattttaatccattcttgacattcagttagtccagatctgccccataatttgctttagtaaagtcactttatggatttttggctatgttttagtttgtgtgtataaaagttctaagaaaacatttttgctattttaagtatgtaagggaagagaggagtgtttttaactttttatagttgatgactttagggtagcacaaacaaaactcctttgtatctaacttttctcaatcctctcttgaggtgctttactaatgggaatgatttctgtatgttcccttggtaccaagaggtactatgcaaagtaacctattacaccaagttacttgctttgctttcctctctatgatgtgataatacagtaaaagccaaacgttgtatttgttcttttcagagttgtccagcccttttttcctttgtccaaaatgattctaaatagaatctaataaaccaatgtagcattatttttttctaaatgaagccccaaaaaagaaaagtgccttgcatcatttaa

SEQ ID NO: 85009 - DNA, 382 bp, Homo sapiens
gttgcagtttgtcaatacggactcaaatatagaagtacggagtccttcttaaggccatatttagtttgcattaacactatgaactaaggaaggaaaggaaattgggggaatgaatatatagcatatataaaagcccgaaagtaggacaaaaaggacaaaatgaagctttttgaacaaactaattcggtatggctgaaggatagactgagaggcagggagttaaaagagatgaaacagaagcaggaaatgggcccaaagaatgcatttggaccattatgtaagacctgtggggaacaattgaaagattttaagaagaggcatgaattgatctgattttatatcaaaagatcactgtaatgtagagaatagattgcggtgtttg

SEQ ID NO: 85010 - DNA, 418 bp, Homo sapiens
tttagtagagatggctttcaccatgttggccaggctgctcttgaactcctgagctcaagtgatccacccgctttggcctcccaaagtactgggattacgggcgtgagccactgtgcccagctatgttttctgagctgtacttataattggttatccaactctccagataactttctgtctgatgttcacccttgtgatttaaaaaattttagctatgtaaaaatagagtttatcattcttgtattttgagtagagcctgcctgcaggatattctatacctgctgaattctttggtgtcagatttcttcaagtcatctgttagtgaatcttttcacaattctctcttacatctccattagtattgtgagaagaaactaaaaactcgagaccccaattcactatgccaaaggaaaaatat

SEQ ID NO: 85011 - DNA, 331 bp, Homo sapiens
tatctgacttggatactcccgagccatgaagggaataaggatacttccaattcccgaacttgagagaacaagacagctcccacgcaccgttcacagggccatatacctttattctaaacaaactaatacactgtcaaaaacctgccggattaagcttttcaactctcctccctactgtggtctgagtgttccaagtctttttctaaacctcactcctaggcttgaagatagattagctataaaggacgatcagccaacaggtagaaaacagaagtgagtatgatgtggtctatgtgaattatgtcctcataaaagcccttaaagaccaact

SEQ ID NO: 85012 - DNA, 838 bp, Homo sapiens
ccgcagtgctgggatgacaggcatgagccattgctctggcccgtgctgtgcgtttgttttcattcttctcaaattagttttcagtttccctgatggtctcttctttcactcactggttgtttaggagtgtgtcatttccacatatttttgactttcccaaatttccttcactgttgatgtccagtttcacgccagtacaactgaagaacactcctgctttggtctcagtccttttccattcactgaggctcattgtggggcctggcacgtggcctgtcttggggaatgtcccatgggcgcttgagaggactgtgtattctgccgttgttgggtggcgtgtgtgatagatgtccactcggcgtacctggtttctggtgttcatctccggaatgttgctgacactagaaaatcagcagctttccaccgttcccagcgccttggctttgggagaggcccgtgagcctgtgggtttggagcctggctgcacgggaggagcacgtgtgggaacgccaggggccggctttgagccccattcccccaacatgatgccgtgtgtggcagacgtgacatttggttttgctcccccagggttccatctgcgacaggggctacttgtgtccctggcctcgtcagctcgggctgaaggcggccctggtcctggccagaggggctttgtgaagcagaaatagatggcctggtgcaggggccaagctcggctagggcctcagccctgggagttgtaaagaaggccggcctctaccatgggcatctgcaccaagctgtgcccatgtcacggtgtgctcagcggttccccgcctgtggggcccaggctcacaga

SEQ ID NO: 85013 - DNA, 379 bp, Homo sapiens
tcacccaggtatctcctaccaactatgatttgtcttcagtaaaccatagtcagttggtaggctcttgatattacatggtatccactaaaacatgttcagttttgtatggctttttttgaatatttcttcaacttgccacaatagttctattatttctgtttgcttagggtggatcattactttctctaagcttcacagggatttgctagcagcataatgatgctatcttctggcatccttatcaggatgtttattttcttatcacaggagatttcttccatgtttataaaattcaccaaattttatgttctgcccttcttgttctagctcttaccagatccattctctcccagctcatacaagtgcatgtggacttact

SEQ ID NO: 85014 - DNA, 259 bp, Homo sapiens
gagagagtgagagcctctgcttaaaaggaatatgatgttgaaaaaaactgacaggcagaaaacaagcctaagtgctgttgctatggaaacattgtaccatctgtgttcttgcctaccctacaccaaagggttatataacctagtaaccagctaaaagttaaaatggaccttacagtgaaaccagttatttttattattttttaaaagggtgactctaagtaaaaataaaacactgcactactgttctttctgtctacct

SEQ ID NO: 85015 - DNA, 369 bp, Homo sapiens
aattacttaggagatcacggaatgtggttctggagttcagaagaagtgccaggctggagtagatttagcatagacgagccgattgaagccatgggagtagatgaggttgcccaagaagaagggcaggtgagagacctggggaaccttactactgaagggctggagaaggaggaagagcagagaagtaggcggaaaaccaggataagtggaaatctctgaagccatggagtattctaagagaagggaagtagagattgctggtgagaatgttgttgagaagtcaggcagttccctgagtaccaaccattgccctttggatttgacaacagggaggtgacctgagcaaaagcagattggagaagggtggga

SEQ ID NO: 85016 - DNA, 270 bp, Homo sapiens
gaggcacagtttcgctctgtcacccaggctggagtgctgtggcacgatcttggctcactgcaacctctacctcctgggttcaagtgattctcctgcctcagcctccaaagtagctaggattacaggcatgagccactgtgcccggcctaatactgggtttttaaatcaggtttttaaccatgaggatttggaacacccaagtttcttcaaataatgaaatccaaacatgttttcagagtaaaccaaatctttccttaatatcagatatta

SEQ ID NO: 85017 - DNA, 273 bp, Homo sapiens
cagcctcctgaataactgggattacaggcatgcgccaccacgcctggctaattttgtatttttagtagagacggagtttctccatgttggtcaggctggtctgaaaacccccgtcttcaggtgatccacccgcttcggcctcccaaagtgctgggattacagacatgagccaccgccgctggcctagagttgttggtaaagtagcgctttagttgctgacattaatggattttaaggaagtattaataacaagatgttcagatggggtgtttt

SEQ ID NO: 85018 - DNA, 965 bp, Homo sapiens
ggcgtcgttactgtggggaggcgacgcagggcggcggagagcgagcggctgaacaggccggttttcaaacctcagccaaccccggaagaacctttggggtattaagagtactgcagtccgaaacatagatggttctattaataacatcaatgaagatgatgaagaagatgtagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttggcaatgttaagcagagttaatgccttggaattgttcccacagtgcctctgcctagctcctacttatgaattggctctgcaaactggccgtgtggttgagcagatgggaaaattctgtgtggatgttcaagtgatgtatgccattcgagggaatcgaattcccagaggcaccgacatcactaaacagattataattggcactcctgggactgtcctagattggtgttttaaactaaaattgattgatttgactaagattcgtgtgtttgtcctggatgaagcagatgtgatgattgacactcaaggattctcagatcatagtattcgtattcaaagagctctaccctccgaatggccaaatgctcctcttttcagcaaccttgaggactcctgggtggcaccttggctgagcaaataatccctgaccctaggttatcagtttaggcagagaggtcaccgaaaaattcggaaattagcgctggtgagccggaagaaatatacaa

SEQ ID NO: 85019 - DNA, 526 bp, Homo sapiens
gcgcctgacacggtcagctcgcgggtggaggcccggagcagaacgccctcgggcgcccgctcttgcagccgcactggagaccgggaatggctccggccacgcctctgccgactgcggcaacgcgagggacagctggtctccggggttgcagcgtaacgccctccttcccggcctcagctttcctgactgcataacgggcatacagtgggttccatggcgcaagggagctgaagaagccgcccgcccccagctcgcccgggatcctcacgcccctataacgccccgaggggccacgatgctgcccacagcccagatcgcgagtgcggaccctgcgggagggtctggcctagatgcgagtttcccgccgcagaccaggcgaggccacgcgacatatcccctacccgcttactgcaggccgcagacggagacagtgcagccctgcgcactgctgaggttgcccgaggtctcagcctcggcgggtcgggaacacgcggcgcgcgcccgcgccccaaccggaagtccgcca

SEQ ID NO: 85020 - DNA, 815 bp, Homo sapiens
gaagctggtccttagcctgcgctgcggagcaacctttcagtggccagctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaaggcccgcccggcaggacgactgagcaggccttggaagaccggagagattggagcggtaagtcgcgctggtcacgttggacacctgcgcgttgggagattctggagccagaaggatagccgaatggccttcgcccgccctgcccctcgcctgcttcagaaacccccggaaacgccccggttgagac

SEQ ID NO: 85021 - DNA, 467 bp, Homo sapiens
atttataaataaaatgtaacatattcacgttctattttgatatgaattaccgtaatattctattaggatatgaattgttataatggccattagaaggaatggattgttcccatatataacataatatatccatgtataaagtatctatataataccaacacgtaacataatgtaaagaaaagagattcatggaataaaatgtgcatgtcattgatataaattttaaaaacacagaaataatacattatattaagactatatatgtatgtaaaattattaccagtggactgatttggatatacactaaattcatgctacttgcttctggaggttgcagtaaagaactggaactgtgtctggggatgtcacttttatctgttttatttagttcattttttataaacaatccttgaggcaaatatgagctgttaataaatgccaattagtctttttgcatattggttgca

SEQ ID NO: 85022 - DNA, 503 bp, Homo sapiens
  misc_feature (468)..(468): n is a, c, g, or t
ggaaagggacttgcagagagacttggctgaataagacattagggatggaacaggatattggaaaaggtactgtaaatgagtttagatagaagattagtttaggaagagaggaagggaccttctttcttagaaacaggaacaagaaatgggaaggacaatgaatcagagattctgaaatattaaagaggaaatcttaaggaattcatattagatggtcctgatctgctcaagaccagataaagagcagagacatagctggatgtttacaactgatgtaaaattttgcaacagctgccacgagaaattaagaaatgatgaaagaattgtatattttataattagaataatttgaggtggacttcatcaatgtagtttcatgacttgactttttttttttcttttgagacagagtctcactctggtgtgcagtggtgcaatcttggtttactgccatctctacatcccagngttcaagcgattctcctgcctcagcctcccaagta

SEQ ID NO: 85023 - DNA, 626 bp, Homo sapiens
ggttcaagtgattgtcctgcctcagcctcccgagtagctggggttacaggcatgtgccaccacacccggctaattttgtatttttagtagagacagggtttctccttgttggtcaggctggtctcgaactcctgacctcaggtgatctgcccaccttggcctcccaaagtgctgggattacaggtgtgaaccaccgcacttggcctaatttttgtgtttttagtagagatagggtttcaccgtgttggccaggctggtcttgaacttctgaactccagtgatctgcctgcctcagcttcccaaagtcctggtattacaggcatgagctactacacctggcctgtattgcctttttatagtatacgtatcttgtctcttttgttttcgtgtgttagagcctcttaaagcaggggatagatattcatgtttcactgaatctaaggtgctgtcagtccaggcttacattattttacgtcaccaagaaagaagaaaacactgctaattatactgtggcactgtgccttcttgtcacttagtgatcctattctgcaggttttgatgctgacgctttctccatctcttgtgtttgtcactggaatttaagcaccttctgccagagtcagaag

SEQ ID NO: 85024 - DNA, 394 bp, Homo sapiens
gattcccttttcatttcacatctcagactcaagccaaatgctgcctcctttgaaaccctccttaacagaaacatgaggaccatttataaaaggtgaccgtagtgtgagataaggggtggaaagtactgggatagcacgtggaccttgatttgatcaaatggaccaagtctcataaaatggctgctgagtgcttttctatttagaaagagaatttcccccaatacggtttcatttgaatctcacacaatccaaaaacagagatagtattagtctcagtttgtaactgggaagatgagctcagagtaaagttccatagctgagaggagcttggactctaaccaagacgttgtatgtgctgtgctgtcttctgtttcccccatgctttctatagttt

SEQ ID NO: 85025 - DNA, 815 bp, Homo sapiens
ccgatttagctgaggacaatgttgcagagaaagggcagctgagggccaccagcagctgacattcacaacaagtggggcaaacaggtacacgggcctcgtgaagggaatgtcagccaggactcaaccccaaccactaaaaggacaatgatgaaatgctcaaactgactgtctaatggacggagtctcactctgttgccacgctggaatgcagtggcacgatctcggctcactgcaacctccgactctctggttcaagcgattctcctgcctcagcctcctgaatagctaggattacaggcatgcgccaccacgcccagctaatttttctagttttagtagagacggggtttcaccatgttggccaggatggtctcgatctcctgacctcgtgatccgtccgccttggcctccccaagtgctgagattacaggcgtgagccaccgcacccggccttttattgtactttcttcctcctctctctcttttacagctttgttatgagttttccccacaagcccatgtatttctttgctcctgtgggcagcgaaaacttttggccttgcctctggacaaatctatcagggctgatagattttgtcattggtacaggccctcgcttctcatccacctccactgcctctctttttgctgatccaaggtccccaacattctccctagctggcagagatcatccctgtttccccattattcagagaaatttagcttagttttgctttaacttccataccatcaaaagtcctaggcccatctctccctaatcaaaggctccatacaaaagagacatctgccctgag

SEQ ID NO: 85026 - DNA, 819 bp, Homo sapiens
gccggggctggatgagtatccccactcccctaaccccactccaacattctatgtgctaccacgctcccctatttcaacccaactggttgaacaggaaacattcctaagatgagcaggtagccggtggagctgaacccaagtctccccagcccatgtccactgacaccctgcatgatcagaaggctttaaagaaccctcactcagaaacctcatattatttttggatgcctccggtgtaaaagcaccccctgcgttccgaataattcatttcaagaaacatggtattaagtgtttagtatgtaccaggcgcctgaataggtgcaggggtaaaaatgtcttgacaccaaggaacctccggcatttgtgaatctgctgaacatcgccattgatggactggatgctgccgcctttgcccctccccctcctgccacgtgtcatcgcgcctacttagcgacacctagtggtcagtaaagagaactatctgaatcaatgacgcctttcaggacttctctcaacagagtttgaccaagttttcttctgctgtgtcagatccctctcccagatcagatcattagaacctcctccagtatcttatgtatatgtgtctagaatgacttttttttgagacagagtcttgctctgtcgcccaggctggagtgcaatggcctgatcttggctcactgcaacctccacctcccaggttcaagtgatcctcccacctcagcctcccaagtagctgggattacagggacacgccaccacgcccggctatttttgtatttttagtagagacaaggtttcaccatgctggccaggctg

SEQ ID NO: 85027 - DNA, 396 bp, Homo sapiens
cctggtcgatgatccttgaaacatacacccggcggcagttcctgcaggaaggaggctgagctaccacgcctgcgggtgacccggcctctggtgccagagcctgccatgcttcctgtttgtgctgccaggctggcagggtcccttgccaccgacctcagccgcagccacagcctgctccctccctgggtggatttgaaggagcctcccccaccctccgcccctagcttgctccttgaggaccctgggcagggtggctgccatggggcccaatcgtgcgtgggaacctgcgagctggcaaacggggctcgggggttttgcccagaaatgggtcagaacgaaagcctctcagaggaaagaaaagggcatgagtcaaagagaaagtcggggggcaggggc

SEQ ID NO: 85028 - DNA, 505 bp, Homo sapiens
gccgacaaaaatgttgtttcctcctacagaatactggttaatttaattgtaatttatttcacaatagacttaaagaaaaaagtataccagaactaaaaaaggtgttccctagacagaatggttattattaaaaagtcaaaatataacagatgctggcaaagctgcagaaaaaagaatgcttatacactgctaatgggaatgttaattagttcagccactgtggaaaacagtttggagatttctcaaaagaactcacaactaccattcaacccagcaatcccatttctagatataactcaaaggaatataaatcattctaccacacacgtgttatgttcatcacagtactattcacaataacaaagacatggaatcaacctagatgcccatcaacagtggactggataaagaaaatgtggtgcatatacatcatggaacactatgtaaccataaaaaagaatgagatcatgtcctttgcagcaacacaggtggagctgggggccat

SEQ ID NO: 85029 - DNA, 369 bp, Homo sapiens
ctaatcaatggaattttattagtgctttttgaaaaatacattaacagcataaggaagttcttttaaatctttgtatagtgatgggatcagagatacaggattgaaatgaactaaacaattttaatatggttctttggagtttattgtcataaatttactttattagagtatcataatacagcatttataaaatgttgcatttattttatatcaaattctattgtgaatttttgagacagagcctcactctgtcgcccaggctggagggcagtggcacaatcttggctcactgcaagctccgcctcttaggttcataccattctcctgcctcagcctcccgagtagctgggactacaggtgcccgccacc

SEQ ID NO: 85030 - DNA, 340 bp, Homo sapiens
gggaaggaggaaggggggaccaagagttgaaaaactattgggtactatgctcactactttgatgatgggatagatcatatcccaaacctcagcattatgagatatacccatgtaacaaacctgcacatgtactgcctgtatctaaaaagtggaagttatgtattaaaaaaagtttggtttggaaaaccaaatacaaaatatttcaaatacaaatgtttagtataatgtggatattaaaagtgaaaggtgtcagaatgccttggggtcccatttgaccttggacaaattacttaattctcctgcctcagcctccggagtaactgggatttacaggcacctg

SEQ ID NO: 85031 - DNA, 427 bp, Homo sapiens
tgatagagattgccaaattgtactcctcaggagctgaactaatttgtactctcaccagcaatgttagggacatgcttgtttttccaccgcatcaccaacagagcatgttattaaacttttggatttgggccaatatgataggtaaaagaatgttttcttagtgtttaatttgcatttctcttattatgaatgagattaagtattctattatatatttaataggtgtttgtatttccttttctgtgaactacatgatcatatcctttgcccatttttctttgggtttttgtctttctaaaattgtttttggctggatgtggtggctcaggcctgtaatcccagcaattttggtggctgaggcaggcggactgcttaagctcaggagttcaagactatcctgggcaacatggtgaaactcccatctcta

SEQ ID NO: 85032 - DNA, 385 bp, Homo sapiens
attatgctggttcagatataatctgcatcctttctaaaactggagacactatataccatttactcatctctgcttgtgccttatttatatggctgtgatttcttatatctcataaaacaaaatattggcttaaagtgcacttctatagcctgggagaaggccttggatcttcaaaaatgcatacagtgcaaaagtggcaaagattatagcaaacaattgcttctatttaatgttttccacatgtcttaacttctgtctacctggagttaactgtctacagtggagctctgtcttgaggagatgtgtagatagctgtggaccctagcctcttgtttagcatcagctgcaaagtctctcctcatctaccaatacacatagaagcttg

SEQ ID NO: 85033 - DNA, 1635 bp, Homo sapiens
gttgctgaagcttcatcctttgctctcattctgtaagtcatagaaaagtttgaaacattctgtctgtggtagagctcgggccagctgtagttcattcgccagtgtgcttttcttaatatctaagatggtgcgtgagcagtacactacagccacagaaggcatctgcatagagaggccagagaatcagtatgtctacaaaattggcatttatggctggagaaagcgctgtctctacttgtttgttcttcttttactcatcatcctcgttgtgaatttagctcttacaatttggattcttaaagtgatgtggttttctccagcaggaatgggccacttgtgtgtaacaaaagatggactgcgcttggaaggggaatcagaatttttattcccattgtatgccaaagaaatacactccagagtggactcatctctgctgctacaatcaacccagaatgtgactgtaaatgcgcgcaactcagaaggggaggtcacaggcaggttaaaagtcggtcccaaaatggtagaagtccagaatcaacagtttcagatcaactccaacgacggcaagccactatttactgtagatgagaaggaagttgtggttggtacagataaacttcgagtaactgggcctgaaggggctctttttgaacattcagtggagacaccccttgtcagagccgacccgtttcaagaccttagattagaatcccccactcggagtctaagcatggatgccccaaggggtgtgcatattcaagctcacgctgggaaaattgaggcgctttctcaaatggatattctttttcatagtagtgatggaatgcttgtgcttgatgctgaaactgtgtgcttacccaagctggtgcaggggacgtggggtccctctggcagctcacagagcctctacgaaatctgtgtgtgtccagatgggaagctgtacctgtctgtggccggtgtgagcaccacgtgccaggagcacagccacatctgcctctgagctgcctgcgtcctctcggtgagctgtgcagtgccggccccagatcctcacacccagggagcagctgcacatcgtgaaagactgaggcagcgtggatgggaagtaaacgcttccagaggaactcagaaaaaattatgtgccagtgaaagtgtttggacaaaaactacatgatctcaaaatgcacgtggatgtgagacacaaaagttgacaaaatggaaaagcaatgtgtttttccactggattaattttcaccggaacaattgcgaattctctctgcctcgcctccccctatcttgtccgtgtgggcacacactgagtgttgagttgccgtgtggagttaatgtatgacgctccactgtggatatctaatgccctgttgagagtagccttgctcagtactaaaatgccccaaagttctatacagcatttcctttatagcattcaaacctcacatcctcccttcagtttaatgcaagtaagtcaggtttcacaagaaaattttcaagttttgaagggaatttgaggttgatctggttttcaagatgtagttaaaggaataaatcactcaaaattaaactttctgtatatagtcaataagcaataaaaacctcatttttcagagttaaaaaataaga

SEQ ID NO: 85034 - DNA, 772 bp, Homo sapiens
tttttttgagacagggtcttgctatcatccagactggagtgcagtgcagtggcaccatcctggctctctgcagcctcaacctccgagctcaagcgatcctcccacctcagcctgccgaggagctgggaccacaggcatgtgccatcatgcccagctaattttttttgtttgtttgtagaggtggggtctccctatgttacccaggctgatctcgcactcctgagctcaagagatccttctgcctcaggctcccaaactgttgggattacaggccttcattgcttcaatatctcttataaggaaagactgaaaacagcacaagtacagagaaccaagcatgtggttgattctacatccacccagtgtgacaccatgcagctgtcaaacatgaaggaggacagtatctaggtactaatgtggaatgatattgtcaaatgaaaaagctaaggtgcagagtggtgtaatatgaaagagaagaaaataaaattacatgttcccacactagtttttgcataaagaaaccttggagggaccaaggagaaatgaacacagatgatttcttgcaggggtagatgacagcacaaggtgaagaaggccgggggtgtttcgtattctatgcatttttaaatgttttcattttgggaacattttaatatagcaaaaaacaacaatctgcacaaaacacgagaagataacaaaatatttttctaactattgatatgggaaaataaagaagagatggttaagagtttgataccatggccaccactaa

SEQ ID NO: 85035 - DNA, 793 bp, Homo sapiens
gacggaagatggcgacgagcggcggcgaagaggcggcggcagcggctccggcgccggggaccccggcaacgggggcggacacgaccccgggctgggaggtggctgtgcggcccctgctgtccgcgtcctactccgccttcgagatgaaggagttgccgcagctggtggcctcagtcatcgagaggtaccgggcggcggctctggcgggcgacgctgttgtggggggaggggatttcgagccggatcgtctggacccgctttccgggccgccccctgcccccttgaggatccccgccacagccacggcttcggggtcccgggcccggggagactggcttgcctgggtttccctccgccaacgcatgtaaatcacctctacctcagtttcccctctcgagcaaaactttagcggcctccctgcgggagggcgtggccggacatggttgagagtgagatgcattcgccctcttaagggaatgttcacggggctgccccttgggtcaagtcacagatgagtttgcatttctcgcccgcactcatcctcctagcctgggccggagcggagccgtacggtataatttaataacggtctccccgcggtgctgtaatcagtgggggcacgtgctatttctgtgactgaagccactagctacattgatgacctctttttacgttgcactccttgtgcattcctactgtatcggtctttgattaaaaacatttcagtgtgtgtctgagagatcattttcccagaggatgtgtggtgtgtgtgttctcttgctgcctcccatcc

SEQ ID NO: 85036 - DNA, 723 bp, Homo sapiens
aagagtgtgtgattggtgcaaaagagatcaactaggatttagaaaactctgaacaaaagaagcttcaaatctctcagcctcaggtttctcctctggtaaatgaaaaggttgaaatagataatttataccggtattcctgctttatagttcataaaatattttcacgccttcttcttaattgctccctataatcaccccatgaggtaggaatttcataggtgaggaaatagactaagatgtcaagctactaaactggtttaatagttggtgggaccacaggcttgaactaggttagactctgtctccaaatctcctaccatgatgcaaaagacagttaccatcctacacaggtgcattccaacaccaacatcaccaacatcctataactccgtgtgttatgtgtacagtctttcctgcagttattgactataataaatgttaatcaggcaaaagcagctgccattcaaaaagaggtaactaatctgtagttgattacaaggaactaatctagacacatcctttcaaagtcacaatttcatgtggtcaaatgaaggctgtaacacatggctacaaagatgaggaacaatagacactgggcctacttgggggtggagggtgggaggagggtgaggatcggaaaaccaccttttgggtactaggctcactacctgggtgacaaaatcatttgtacatcaaaccccagtgacacacaatttacccaca

SEQ ID NO: 85037 - DNA, 754 bp, Homo sapiens
agcctagtgacatttatttatttttaagatttcttttaaaaaaatattgagtgattggtcaattgactgagacagggtctcactctgtcgcccaggctggagtgcagtggtgtaatcttggctcactgcaacctccgcctcccaggcccaagcaatcctcctgcctcagcctccggagtggctgggactacaggtgtacactatcacgctcagctaatttttgtatcttctgtagagacgggatctcaccatgttgcccaggctggtatgtcaagctactaaactggtttaatagttggtgggaccacaggcttgaactaggttagactctgtctccaaatctcctaccatgatgcaaaagacagttaccatcctacacaggtgcattccaacaccaacatcaccaacatcctataactccgtgtgttatgtgtacagtctttcctgcagttattgactataataaatgttaatcaggcaaaagcagctgccattcaaaaagaggtaactaatctgtagttgattacaaggaactaatctagacacatcctttcaaagtcacaatttcatgtggtcaaatgaaggctgtaacacatggctacaaagatgaggaacaatagacactgggcctacttgggggtggagggtgggaggagggtgaggatcggaaaaccaccttttgggtactaggctcactacctgggtgacaaaatcatttgtacatcaaaccccagtgacacacaatttacccaca

SEQ ID NO: 85038 - DNA, 1970 bp, Homo sapiens
agcggactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccaggagtttcctgatgggtcagggtggggaggctgcacaccacacaaggtcaccctactctaccttctacccaccctaccacagccctgagctcaccactcccccagggcatgggactcttgataattccaagtccatgaaaccctacaattattgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcagggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatgagaacttcttttcctttccttttgtctgtgaagcactgtgattctgtttctactggaaagatttttttctttttaattttcttttaaacttatttaatttgtttgaacaaggtgtctaagaatatactgttgaataaagacatgcacacagcataattcaatgtctattttggttgtacagtaattataaaatgcatgttattaaaaccagatgagtaaaatgatgtgtttataattattaggaattatatattatgtatcttttaaaaattgaaattttaaaatatggagaatatcactaagctgacaatgatattgggagatgaatttgcaacaatataaaaagctatgcaattttctttttattaaggatgaatctaaatgcattcaattggtaactattcctcttcaagtatttgcagatggggcaacatgatatttgggtagctgatgtcataattcggggacaattatctcaatcatcaagaaaaaaatttcagcacttgttttgtattattcagaaattaactgtacaggtttgttatcacaatgtataattgtgtttttccaccccacatttttaaggcaattaaatatagatatttccactcgtaaaggacat

SEQ ID NO: 85039 - DNA, 1981 bp, Homo sapiens
  misc_feature (27)..(27): n is a, c, g, or t
agagagagagagagagagagagagagnagagagagagagagagagagagagacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccaggagtttcctgatgggtcagggtggggaggctgcacaccacacaaggtcaccctactctaccttctacccaccctaccacagccctgagctcaccactcccccagggcatgggactcttgataattccaagtccatgaaaccctacaattattgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcagggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatgagaacttcttttcctttccttttgtctgtgaagcactgtgattctgtttctactggaaagatttttttctttttaattttcttttaaacttatttaatttgtttgaacaaggtgtctaagaatatactgttgaataaagacatgcacacagcataattcaatgtctattttggttgtacagtaattataaaatgcatgttattaaaaccagatgagtaaaatgatgtgtttataattattaggaattatatattatgtatcttttaaaaattgaaattttaaaatatggagaatatcactaagctgacaatgatattgggagatgaatttgcaacaatataaaaagctatgcaattttctttttattaaggatgaatctaaatgcattcaattggtaactattcctcttcaagtatttgcagatggggcaacatgatatttgggtagctgatgtcataattcggggacaattatctcaatcatcaagaaaaaaatttcagcacttgttttgtattattcagaaattaactgtacaggtttgttatcacaatgtataattgtgtttttccaccccacatttttaaggcaattaaatatagatatttccactcgtaaaggacat

SEQ ID NO: 85040 - DNA, 1664 bp, Homo sapiens
agcggactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccaggagtttcctgatgggtcagggtggggaggctgcacaccacacaaggtcaccctactctaccttctacccaccctaccacagccctgagctcaccactcccccagggcatgggactcttgataattccaagtccatgaaaccctacaattattgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcagggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatgagaaaaaaaaacaaaaaaaaaaaaaacaaaacaaacacacaaaaaaaaagggggcgcgcgcgccccaaaagaatccccccggggggcgcccaatttcggcggtatccccggagttttctgtggcaaacaagggggggcccccatatataagggcacgccgcaattataataggccagggcactcgggcccgccgactttaaaagacgagtctgcggacagtgggagaacaacacggctaaagccggggggacactcgtgggaagagagaccctataccgacgggaggagcgaaccaaagtgcgcaccaccccccag

SEQ ID NO: 85041 - DNA, 616 bp, Homo sapiens
  misc_feature (545)..(545): n is a, c, g, or t
  misc_feature (549)..(549): n is a, c, g, or t
  misc_feature (566)..(566): n is a, c, g, or t
  misc_feature (576)..(576): n is a, c, g, or t
  misc_feature (588)..(588): n is a, c, g, or t
  misc_feature (608)..(608): n is a, c, g, or t
ggccctccacatcctcttggataatgtcaaagtattctctgttcaattttgaaacagtcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagntggnccctccagaatgtaatnctccaccctnaaattcaaaagnctgaaggaacctgggaaccngtgggaaa

SEQ ID NO: 85042 - DNA, 2582 bp, Homo sapiens
catctcgcacttccaactgccctgtaaccaccaactgcccttattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaatt

SEQ ID NO: 85043 - DNA, 2641 bp, Homo sapiens
catctcgcacttccaactgccctgtaaccaccaactgcccttattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaatt

SEQ ID NO: 85044 - DNA, 2320 bp, Homo sapiens
catctcgcacttccaactgccctgtaaccaccaactgcccttattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaatt

SEQ ID NO: 85045 - DNA, 445 bp, Homo sapiens
aaaaaaaggaaaaaatgcatacatagatatacatacatataatatacatcctataaaagccatttaaaacattaaaacaaaaataaaaggtaaaaactgaaattaaataggaaatttgggcaagcatgtgccatagaagaagcaagagactgataaaatatttaacaatcagtttggcatggaaacgaactaagccaagtgaatgctagctattaataaccagtaagcaatgcttttatataaaaaagagattggaaaggtgattttaaaagacaccagggcttgctttttgtccttacccttctaccccaggctcttctgccttccctcttctctttccctttttaccctccctcctttatgtgtctactctttcctctctccttgcccattttcccttctcttttccctctactcctatgccattgtgttgggggaagtcctc

SEQ ID NO: 85046 - DNA, 415 bp, Homo sapiens
atatggatatctggttatgtggcttatccacagagtccagcctaagatctgggtttaaattatactgctgtcatttttttccttttgagggagtggatatagtagaaagaattgggatttcaatattttctccagaacttactagctttgtgaccttggatagttaatttatgctccttcgcctcagtttgttcatctataacaagggtagttgtaaggattgaggacactgtcttgggaaaaatggcttgcatatattaagtactcaataaattataggtattagccccttttattaaaattattttttactgtttggggataatcttccttcaatctttttattttttgcactagtagcgcctgttctaaaaaaagtgtgtttatattctataggactggctgatagtctaag

SEQ ID NO: 85047 - DNA, 630 bp, Homo sapiens
ctggcctttgcttcccagattgaattagaggagggaagtcccaggtgctcctccctcaacagtggcagtgggcgtgggtctgctcttccagcccaggcaccctctccccactgggtggttctgtggtgccttttcatttccaggccatttccatctgggagtgagcgtggaacacgaccccgttctgagagagcccactgggaccgtggcacccccatctcaggagtctgagcccctagtgatgactggctcatgcttagggagcaaagcgcccataaatgtgagcagcactctagagaccccgagccaccctggcacccgggcacggacgcgttgctggagcgtccatggacacggtggggtgtctgccccctctctgctgcccaacccccgaggcatgcccgccggttccctgcctccacctgaatgtggcctttctgcagtgttgactccacagcaaacttccagccgttacctctgtggctatgactgatggcatcagttcttctgtggaaaagacccctgggcgtgggactcctgagcaaagatggacccgcctcccctgcccaaatcccaacctgcttcctggtgccctgtcccctaccccagtaaaatcaaatgtgcatccaa

SEQ ID NO: 85048 - DNA, 373 bp, Homo sapiens
gcaaagggcagaccaaactctgcagctgcttgaccaccacatcttagctctttcctcccccagccagagtcgcatctgggcaggagtgtccagggtgtctgccctctgcacctgtgcagtgtcccctgtcactgtggagtggccagcattggggtgagatggccctgactgcagttggaccaagaaactctatagaggcccctgcctcttccccaccctctgatgcggggatggtcggtggctcccagagttcaggcaggacatggagcccattgcagccggccgtgcttgatgtgtacacgggtgtgtgacatgcaggcattcacacttacatacatacacccttccctagctgtagcagccaggtgtggtt

SEQ ID NO: 85049 - DNA, 3131 bp, Homo sapiens
ggaagagtaggggcccggacgctgcagcaggcggggcacccggactggcggcttcgctggcgcaaggtcggtccggcggccaggacctggaaggctgcgaggccctgcgaggtcgaggttcggagtttgctggtcccaggcccggcccgaggtaagaaagagccgcctccccgcacggccggaggacccgggcgccccgagttcgacttctcagcctccgtccggacgggaaacggagcacggagatgttcctgaggtctctttcctgggaagcgcagccccgatttcccgcccctgtcccttagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgct

SEQ ID NO: 85050 - DNA, 3376 bp, Homo sapiens
ggaagagtaggggcccggacgctgcagcaggcggggcacccggactggcggcttcgctggcgcaaggtcggtccggcggccaggacctggaaggctgcgaggccctgcgaggtcgaggttcggagtttgctggtcccaggcccggcccgaggtaagaaagagccgcctccccgcacggccggaggacccgggcgccccgagttcgacttctcagcctccgtccggacgggaaacggagcacggagatgttcctgaggtctctttcctgggaagcgcagccccgatttcccgcccctgtcccttagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaa

SEQ ID NO: 85051 - DNA, 2555 bp, Homo sapiens
ggaagagtaggggcccggacgctgcagcaggcggggcacccggactggcggcttcgctggcgcaaggtcggtccggcggccaggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcagtgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgct

SEQ ID NO: 85052 - DNA, 2943 bp, Homo sapiens
ggaagagtaggggcccggacgctgcagcaggcggggcacccggactggcggcttcgctggcgcaaggtcggtccggcggccaggacctggaaggctgcgaggccctgcgaggtcgaggttcggagtttgctggtcccaggcccggcccgaggtaagaaagagccgcctccccgcacggccggaggacccgggcgccccgagttcgacttctcagcctccgtccggacgggaaacggagcacggagatgttcctgaggtctctttcctgggaagcgcagccccgatttcccgcccctgtcccttagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtcctccggtgacacagaatttacgtttccacttactgggctttgggcctactggt

SEQ ID NO: 85053 - DNA, 1800 bp, Homo sapiens
ggcgtgggtgaatcggccgaggaggtgtcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaa

SEQ ID NO: 85054 - DNA, 654 bp, Homo sapiens
gtgactcagcctctctcccctcattcttccacagctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaa

SEQ ID NO: 85055 - DNA, 293 bp, Homo sapiens
ctggctcgccagggctacccacggatggcgttctccgcctgctttggcggcatcatcttcagtatcctttgtggtctgttcttggccttagcactggtgtcacagccgtgggtggggtgtgctccatgccccaccctggggattggttctcggtgtaacacctggggcaggtaatgtggctgcctgagcctcaggctccaaggctttaaaatagggatttggggagtgctaacctccaagtggtgttgtaaggatccagtgaggtgaatgaaattcttggcccctggtaaggg

SEQ ID NO: 85056 - DNA, 3544 bp, Homo sapiens
ggaagagtaggggcccggacgctgcagcaggcggggcacccggactggcggcttcgctggcgcaaggtcggtccggcggccaggacctggaaggctgcgaggccctgcgaggtcgaggttcggagtttgctggtcccaggcccggcccgaggtaagaaagagccgcctccccgcacggccggaggacccgggcgccccgagttcgacttctcagcctccgtccggacgggaaacggagcacggagatgttcctgaggtctctttcctgggaagcgcagccccgatttcccgcccctgtcccttagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaa

SEQ ID NO: 85057 - DNA, 3974 bp, Homo sapiens
ggaagagtaggggcccggacgctgcagcaggcggggcacccggactggcggcttcgctggcgcaaggtcggtccggcggccaggacctggaaggctgcgaggccctgcgaggtcgaggttcggagtttgctggtcccaggcccggcccgaggtaagaaagagccgcctccccgcacggccggaggacccgggcgccccgagttcgacttctcagcctccgtccggacgggaaacggagcacggagatgttcctgaggtctctttcctgggaagcgcagccccgatttcccgcccctgtcccttagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaaaaaaaaaaaaaaaaaaaaaaaaaaaaaaaaaaaaaaaaaaaaaaaaaaaaaaaaaaaaaaaaaaaaaagccagcaacaaaaaacaaacacaacaccacagaggaccacaaaaagagaggggcggcggacagaacacactggcgcgcaagccgagacgccccacacactctagacagggggccccatcggcgcaccaccaaaacaccacacgcggcgacgcccacaaaaccgcaccagaagagaaagaaaacacacacacacgcgcaataggagacaccagcaccacacagcgggggggacagcaaataagaagcccaccaccacaaaacaagaggacaccccgcaggaaaacccaaacccccccgaaatcacggagcacaccacgcacaacagcgaggcaaagcgaccgcacgtacaatgataggaatac

SEQ ID NO: 85058 - DNA, 3443 bp, Homo sapiens
ggaagagtaggggcccggacgctgcagcaggcggggcacccggactggcggcttcgctggcgcaaggtcggtccggcggccaggacctggaaggctgcgaggccctgcgaggtcgaggttcggagtttgctggtcccaggcccggcccgaggtaagaaagagccgcctccccgcacggccggaggacccgggcgccccgagttcgacttctcagcctccgtccggacgggaaacggagcacggagatgttcctgaggtctctttcctgggaagcgcagccccgatttcccgcccctgtcccttagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagattcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaa

SEQ ID NO: 85059 - DNA, 2572 bp, Homo sapiens
ggaagagtaggggcccggacgctgcagcaggcggggcacccggactggcggcttcgctggcgcaaggtcggtccggcggccaggacctggaaggctgcgaggccctgcgaggtcgaggttcggagtttgctggtcccaggcccggcccgaggtaagaaagagccgcctccccgcacggccggaggacccgggcgccccgagttcgacttctcagcctccgtccggacgggaaacggagcacggagatgttcctgaggtctctttcctgggaagcgcagccccgatttcccgcccctgtcccttagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggaggtgactcagggctgggtggggttgagtgggggtgagtgcggccacatcttagctctttcctcccccagccagagtcgcatctgggcaggagtgtccagggtgtctgccctctgcacctgtgcagtgtcccctgtcactgtggagtggccagcattggggtgagatggccctgactgcagttggaccaagaaactctatagaggcccctgcctcttccccaccctctgatgcggggatggtcggtggctcccagagttcaggcaggacatggagcccattgcagccggccgtgcttgatgtgtacacgggtgtgtgacatgcaggcattcacacttacatacatacacccttccctagctgtagcagccaggtgtggtt

SEQ ID NO: 85060 - DNA, 1416 bp, Homo sapiens
gcgtggatgaccagggagggtgggggaagcgactcaccactgcaggcccctcttgttcctgtgcagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaa

SEQ ID NO: 85061 - DNA, 399 bp, Homo sapiens
ctgttttctccttttgttttcctatttattctcccagtgctaacttgatatcttcttgtgtgtacacgtgtgtgtgtgtgcaaatatatttctaggaacaagagcaaacattctagtaactatcattctctgatgtggagaacttgggcagagatctgagttacagctttgtggatttattctctctgatgagagatcgccccttagaatgtcatggtcctaaccccgtcatggataccaggggtgaatggcagggttcttctcctgcccaggaggaagggtatggggagccggtgcatcttgactgtcaggtcacctgtcttaccacctttacagctaggctttctgaggtgccagcgtctcctggaattcaaactgtagtttagaggcagctggtga

SEQ ID NO: 85062 - DNA, 722 bp, Homo sapiens
ggagtctttgcatgactgaaaggtattggttttctggagcattcattatgaaaagagatgtgagcttgatttgtcaaatgatttaacatttcagtgacagagatgccccgtggataggccattttggtatgtgtactggtgctccctgcattggattttgaaattatgaatggcactgccatcattgtcccatcccttattttgaccatgacatgcaagaagcactaggcactgtgaacctctccgtacagtcacgcgtgctgctcccacgtggcatttctccagataacacagatggaaaaacgttttggtgtgagattgatgtgcctgccttgatcagccaaatcattcctgccaatgctcctagggcaagagtgcagtttcttctttttgtctgagggtgtgtcatgctgcatcccagatgcagtgttcttggtttttgggactgctgcttcaatagaagcttagaatttctgtacagtacagttgggcctcattcgaattagcttttggaataacctccaaatttgtgttctcgtgatttggttgaaccgctgaattgctatttccattgataataaggtatagtagttccaagaaccaggaatgtggctttgaaaatgcaattgttagaattttgtaagagattgcaggccaaattattttttcatttttaggagtgtgtgaaccagttttgggacatgctggatgaagtaggtgac

SEQ ID NO: 85063 - DNA, 136 bp, Homo sapiens
tcataatccatctgcctcggcctcccaaagtgctgggattataggcgtgagccaccacgcccagctgatagaaattttaaagttaaaagattataactgtcattctgttaccgaagtactatataaattaccttct

SEQ ID NO: 85064 - DNA, 224 bp, Homo sapiens
aaaaaagctaatagtttaagtattagtaatgtactaaaattaaaatgaccttaaaaagggattcaggtatttcatgctaaattttcctttgattttaagttaccaactgatagagtacaaaagtgataactttctgaatattgttgctgtaaacaagcatatattcagttcctcctgtgtgaaaagaagccaaatgtaatgattgtggtcttattcagcgacaa

SEQ ID NO: 85065 - DNA, 200 bp, Homo sapiens
aaaatttaaaacaatactagcaaagttgcaaagaaagcaactaatttagcaagttaactttatgatggagaaatgtgatagacaccaccttaaccaaacaatcaaacttcatcttcgacaatgggactcgttcctccagatatgatacacagatagacacaacgtcacttacataatattctcacaaaagaatgtttaac

SEQ ID NO: 85066 - DNA, 436 bp, Homo sapiens
tgggactacaggcgcccaccaccacgaccagctaattttttgtatttttagtagagatggggtttcactgtgttagccaggatggtgttgatcttcctgacctcgcgatccacctgcctcggcctcccaaagtgctgggattacaggcgtgagccacagcgcccggccgaaaattgaattctaaactttatgaatatgaacccacactgattagttcacttttctaaattaatgctgggtatgaattaaaagctacaaatattaatctgtattagtacagaaaaccaaatattacaaggttggaatgttagaattttacaaatatctaaggcatagttaccctaaaaataaaaatcatcctatcaagattccatctactttcagaaatacctactttgctgttttccacttgtgcaaataaagacctattttttat

SEQ ID NO: 85067 - DNA, 507 bp, Homo sapiens
tcgatctagaggatcctcaaacacgcaattctgcgagctgtagtttacattctggctggccgcagccgggtcctcaggacttgaggagagggtcctgtcagggccagcgttctggtggggttttcagccatgaaaatgtccagagaattttggtctgagctggagaggagacaacagcgtggatgtgacactggggagaaaaagcttgggccctgattcttgtctggccatcttggatcatagacgaattattcacaagagggtctctgcctaaaactcaccatggtggctttcttggtgtacttttcatgtctaaaatgtaagtaaagttcacactttaaggctgcagaaggaagtgaaggcttttgatgctgtttacaaatctctggtttctgactcaagaccatgacggtatgggggaacccaggcctgaccttctcccagttttgggggagctgcctcctgcgattctccctcggtggccctgttggggtggggcccatttcc

SEQ ID NO: 85068 - DNA, 351 bp, Homo sapiens
tttttttaagaaggtatatactgtggttgattgtcatgatgcctgcaattttaaaatgattcagagaaacagattacagatagcaaatagggtaaaatgttaattgaattcagatttagctgtattttgtgtctttgaacttttccatgataaaaacttggcgggagggaaacatacctctttaaagttaatataattttcacaacttgacttgtgttgtttcttaaattgcaagcagatacacaccttttcatagatttaatctgaaaacattctttctcttgacccttatgattgaagtgactttcatgtaatttatttattgagaagattttgaaaaaagaaaataag

SEQ ID NO: 85069 - DNA, 451 bp, Homo sapiens
tacgctgaagctacaccaaatttatcttaacagtttttcttcaataaaaaattataactttttaactttgtaaactttttaattttttaacttttaaaatacttagcttgaaacacaaatacattgtatagctatacaaaaatattttttctttgtatccttattctagaagcttttttctattttctattttaaatttttttttttacttgttagtcgtttttgttaaaaactaaaacacacacactttcacctaggcatagacaggattaggatcatcagtatcactcccttccacctcactgccttccacctccacatcttgtcccactggaaggtttttaggggcaataacacacatgtagctgtcacctatgataacagtgctttctgttgaatacctcctgaaggacttgcctgaggctgttttacatttaacttaaaaaaaaaa

SEQ ID NO: 85070 - DNA, 408 bp, Homo sapiens
cgtctaccttctgctctgattctgggccccctcggccttcttgccctggttctgagccccctctccctttttgccctgattctgggccccctctgcctttttgccctggttctgggccccttctacctttttggcctggttctgagccccctcggcctttctgccctggtgttggggccccctccacctttttcccctggttttggggttgtatctacctttttaccctgggaacaaggtgagagggggaggaaggagggagggaggagagggaaaaggcctgggcaggcaggtgggcaggagtgtaagacgctcagtgccatgcgttgcctgcaattgacagtaagcaatgctgctaaccttcatgactgtttaggacagtggatgggtcttttccagtgagcccat

SEQ ID NO: 85071 - DNA, 577 bp, Homo sapiens
tgatcttcatgtattagcatttgagttttaatctttctggggctcctggcagaaaatttctttaaatttattatataattctaaaatattggacatatttgtttcacgcatctgtcaatatccttattcttttcattaaactctccactgcccccattagtcatcaggtcctactgatttttaactcctaagtatttctcaaatctgtctcctcagtgtgtattgttggttatataactccatctccattgtcactgtgctgctttagagtatcttttcttgtctagatcagtgcctggcttatattatgagcttcgaaaagttggatcaatgaatgaatgattcataatctggacaagtgcactctaacacttgactgaaaaacaaaatcttagatctatcttccatgtaaaagcatctatctaaaatgcaaatcttactttgataatctccagcttaatagcttagatggctcccaggcatccccaaaaccatctctcaattcactgatcaaaaaaataaaacttaaaaattttaaaactaaaaaaaattgaacatttcattggtcaaaaaacaa

SEQ ID NO: 85072 - DNA, 382 bp, Homo sapiens
gtaattattaagcaattagaaatgtgaatagttattggaaatgtcatgatattaagtaattttaggtgtgctaatggtattgtggttacattttttaaagagcccttacagagacacatactaaaatatttgggaaagaaatgacatgatgtctgagatttatttcaaaatattatgggaagaagatgggcagaagttaataacagatgaaacctcaaccagctaccctttcttttctcttaagtgtgaatagaaaaccaagaatctgtagtatgtaaaaagaacctgcaatattaaagagaatgactggccaaaaatgtaagagacacttagagccaaaacatgaagtctaacatcagagtaaaaggagtcaaataaagag

SEQ ID NO: 85073 - DNA, 257 bp, Homo sapiens
gcttcccgggactaaacccgacaaaataatgtcaaagctggattctttgtgggcagactgcaacagctggttcatgttttccacagacccacggccctcattgccagttaaccttgaagctcatccaccagacctttcagagcctccactggggatgacttatcccagaccactgccacaaactggccagcagagatcccaaaatctgccattcttgcagtgcagtactgacagacctaaaaactgctagccaaaag

SEQ ID NO: 85074 - DNA, 671 bp, Homo sapiens
cgatcctcccacctcaacctccagagtatctgggactataggcacgtaccaccatacccagctaatattttttttaattttatattttttagagacagggtgtcactatgttacccaggtctcaatcactatgttactccttgcctcaagcaatcctctcaccttggcctcccaaagtgctgagcttacaggtgtcaaccactgtggccagccacgcattggttttaaggtccagaatttttctgtttggagccttcacaattagttttaggttgggagaccgtgaacccaccaagcagccctttagaggctggaaaaagagtttggaaaaagaactctgtggctttaggaatttctctcggaaatcctctagggcagagaaggaaaatttaccaaatgggagagtgtattagtctattcttacattgctataaggaaataccccagactgggtaatttataaaggaaagagttttaattgactcacagttccacatggctgggaaagcctcaggaaacttacaatcatagcagaaggcaaaggggaagaaaggcaccttcttcacagggcggcaggaaggagaagtgcagagcaaagtggggcaaagcctctataaagccatcagatctcatgagaactcactatcatgagaacagcaggggagaaccac

SEQ ID NO: 85075 - DNA, 419 bp, Homo sapiens
aggatgaaaccaacctgctgaggctgggagagtgggaatgaacgagactgcagatgcagaagtcggctggtgggaggggggatcctaacgggactccagacgcaggagttggctggtgggagtggacttgatgtgggatggacctttgcttttagtcgcaggactccaagcaccaaaggagaaaagtggttggtcctctccaggtagagtccctattgagcttagtctctcccacctatctttgattgtgacacttgaccccagttgtcatcatcagctctgattccaggcaagccccagataccaagtggacactcaggggccccacccctaggaagtcactgagccaaagagggctaggggatgacatgcacggacacgggcttagagcttctttgggactgtctccctaagaatac

SEQ ID NO: 85076 - DNA, 340 bp, Homo sapiens
cctgccgggcgacttttgaagatcccccatccgggtacaccatctcaaaaaaaaaaaaagaaaataatggatttgcagagacttgctatttagatttcagacatctgttaactaaaacacatgtgtaggcttttgttacttatttcagtaatctgtaaatatctttatatttgagaaaatttgtgagacatctttgtgtaaattataacttgaagaacctctcttacaagcaggcatattggtaagtagctgcgaggatataacttataaccagattgaagtgtataattataatatgttattattctggggttctataaaaaataaaatctttgaatct

SEQ ID NO: 85077 - DNA, 799 bp, Homo sapiens
ggccggtgctgctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacaatctggctgctgactaccctattggacaactccaatattagagaacatttccaccaattcagaaagtttattatgcactgctgttctagagcagggatcagcaaacttgctgtaaagagccagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatagactgcaaattatgggaagaagtactagcagaagacagtgcactatgagctccttgttgattcaatgaagaactcattccaagattcattaaactagcaaggcgtgcagtaccctggttcatccttccaagagatgctggcatacttaag

SEQ ID NO: 85078 - DNA, 691 bp, Homo sapiens
  misc_feature (689)..(689): n is a, c, g, or t
  misc_feature (691)..(691): n is a, c, g, or t
ggccggtgctgctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacgtatgtagtcttcttgtcatgtaggtcccaattaaattactatagctcagatgggggtaggggacttaaaattatgatgtgaaaaattatgtagagtatcagactttttttggggggggacggagcttgctcagttgcccaggctagagtacagtggctcgatctcggctcactgcaacctctgcctcctgggttcaagcgattctcctgcctcagcctcccgagtagctgggactacaggcacctgccaccatgccaggctaatttttttattttaagtagagacgaggtttcaccatattggccaggctggtctgaaactcctgaccttgcgatttgcctgccttggcctcccaaaatgctgggattacaggtttttttgtttgttttttgagacggagtctcactgtctcccaggctggagtgcaatggcgcaatctcggctcactacaaccncn

SEQ ID NO: 85079 - DNA, 675 bp, Homo sapiens
ggccggtgctgctgcgccctgcggagctccgaacacgtgcgcagaggctggctgtggcagatgcaactgcaggatgacttgaaagtagggcatccttcacccatctgaagggaggaaatagtggcaggtgacagtctgcatgtgcagttttcagatgccttcacctgaatgacatctacctccatcaggaccccagatgtctgacagccctgtgtgacaccaagataagtaacgatcccgttgaagataccacattacacttaggctcctgttggccatgacagcttcttagacttgtttttaatgaccttgacagttttgtttttttgtttgtttgtttttgggacggagtctctgtcatccaggctggagtgcaatgtaatggctcaatctcagctcactgcaacctctgcctcccgggttcaggtgattctcctgcctcagcctccccagtagctgggattacaggcatgagccaccgtgcccggctgcctcctaaattctcaaaacattccatttttattctgtggtcttactttattctgtcatgtagagaatagtggttgagcctgttgtcttttgagagtggatgctgtagtccttacatggctgactttcagcccgtaagcttatagtagaggatccttcttgggccagggcgcctgcttctgccag

SEQ ID NO: 85080 - DNA, 782 bp, Homo sapiens
ggctttgataacagttaaaactttaaattttgtatgcccatagtccagtgaggtcaccttaattcagcatcttggaagctttgctgtccagttacgcgtacaatatttaatttaaaaatcactacagagagtatgttttgacactttgaagtagtttaaccgtttggttatggtcagaaagaacttacccagtgacgtttgatatgtagctttaaaattctctagaatgttatgagttgttttacttacactctcctggttaattatagattataaaaagtcctaatgcgtaattggtttcatattgctttaaagagacttaattgcttggtttttttcccctaatggataggaaactagcagagttgttcacatcatggattttcaacgagggaaaaacttgagataccagctattacagctggtagaaccatttggagtcatttcaaatcatctgattctaaataaaattaatgaggtatgaattgaaatattggtattattcatttattcatgccactaatatatgttctgcaagaattaaatgattttgtattagaaaaataaaactcaaggtaatcttaagtttatcaaatgcagaatgtagtagaggaaacaaaaaccaaaaaaaattttgggcgctcggccttgaagattttaaacatcttggggcgggcccaggtgtacatggctacgcgtccagaacccggcgcaggcggtttcccctaaaaccggggcgggtcgcaaccaggtcgggctaggttaaaggcggactaccccgg

SEQ ID NO: 85081 - DNA, 590 bp, Homo sapiens
ggagaaggaaaatctgtgctctgttcttgtttctatgtaacccacatttctaattctttgtgcggcacttcctccttacaatttaacaaatagaggaaaaacttaatttcaacattatctgcatttgcaagcaatacaaaacaagtttattctcgtggattattttgaagttctgaaatttttcttttgaaatatctattggaaatgctttaaaactatgtttctaacacttagactctcagataactttactaataaatgatctctattttagaggccaaacaaggctgttttgtgaaaaggacagttttattttaaagttaattttctggtctttttaaagctacccagaatggaatcctgacaatgatacaggacacacaatgtaagttaaattttttaagctaccatttgtaaaggagatcaatgtaaggaattcaggtttcactttcaacatttcataaacaaagtattttcagaatttctttactgaaaatgagactttgattcttttattgttaatgtagactttgacctagttacttcacagatactctgaaagattgaagtggttgtggtcatatattggg

SEQ ID NO: 85082 - DNA, 295 bp, Homo sapiens
tctctataaaaataaaacaattggtaaagactaggatgtttttaactgttaactaataattattgcacatttgtccttttgttgttgttatttattaaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattactgagtaccgctatgcccacgattactgattcgatctccgtaccc

SEQ ID NO: 85083 - DNA, 525 bp, Homo sapiens
ttagagcatcatactcttcatcttttagggcactaaggtgactgcaagaaattaaccagtagtaaaaatagtctgttttttgtgtgtttgggatttgtttatgtgtttttttgcatgggttacttacagcagttctctccacttttaatgtgctccaaagggagaggtcttaagaaagaatagcagtctgcacttatcaaactcacctgggtgacagactgagacagtctcaaaaaaaaaaaaagaaaataatggatttgcagagacttgctatttagatttcagacatctgttaactaaaacacatgtgtaggcttttgttacttatttcagtaatctgtaaatatctttatatttgagaaaatttgtgagacatctttgtgtaaattataacttgaagaacctctcttacaagcaggcatattggtaagtagctgcgaggatataacttataaccagattgaagtgtataattataatatgttattattctggggttctataaaaaataaaatctttgaatct

SEQ ID NO: 85084 - DNA, 4778 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85085 - DNA, 5094 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatggagttcttcagtgtttcctttcagtgatggctttttcatagcttcaactttgttggatttagcaagttgaaggaaagaatgctatgtttttaatacctacatttgagagcatttagaaatcagaaattataataagctgttagtgataaatctgtaacagcccttcgattacgagaaaacctctttttagtaggaatgtttccactcatgtttgctgtaaagtttaagaacatttttcctacggctatgtcagcccttagtttaatcttacattatcctacaaaagtgaatgaaacttctagaagtaaaaaaaaaaa

SEQ ID NO: 85086 - DNA, 3913 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaaaaaaaaaaaaaaggggggggccaaaaataccgaggggcccattacgccacttttttaaagggc

SEQ ID NO: 85087 - DNA, 4038 bp, Homo sapiens
  misc_feature (3852)..(3852): n is a, c, g, or t
  misc_feature (3855)..(3855): n is a, c, g, or t
  misc_feature (3860)..(3860): n is a, c, g, or t
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacnccnacacnaaaaaaaaatttggggcggccgccccaaaaaagtttcaaacacatctcgtggccggcggcccaggtttgactcggccacgcgtgccaagggaacccggccagcctcggccgggtcccccaaaaaaccggggccgcgcgcttgacaccaggctcgggcccggctcaagggccgcgaacg

SEQ ID NO: 85088 - DNA, 3895 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaaaaaaaaagtcgagcggccgcgaatttagtagtagtaggcggccgc

SEQ ID NO: 85089 - DNA, 5633 bp, Homo sapiens
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85090 - DNA, 3960 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggcaaaaaaaaaaaaaaaaaaaaaaattgtgggggccggccccggaaagttttcaaaaccatccgttggggcggggcccagagatgaacatggccacgggaccaggaccgggcagagaagggggtccccaaaaaagcgggggacgggttga

SEQ ID NO: 85091 - DNA, 4922 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaagcgtcgttttccagggagtatggaaggttttgtcactctagatgaggttggtgatgaggaagattcggaacttcagaaacttcgtaaatcgggcatggcatttaaatctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85092 - DNA, 4834 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgacaaaagatcttcactctaccaggactgggcacaagaatctccaatgtgcactcaacgcaacacacctccccaaaaaaccaccccttggggaacctggcgatttccccagtactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85093 - DNA, 5279 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtgagatttaagtctttgttcttcaccttcctcactctcctcaaaacaaactcttaggttttaaaataagattttaaagttggtcttacataagctgtgatagcattttaaatttgctttgtttctatggggaacaatttataaatcttaattgatatattttcctctcatgcatgtctctgattttgtattattttctgttgttattccacaatgtgttccctttttttcgtaaaatttcttgcaagttacacgcttttgttttgcttttctgtgttgtttttctgtattatatttctttttttaagaatacagttaggtgagacctcaaacatcaattaggtaaaagcaaaatatggttcggtttttgttttttatcttaggctgtattggacttctcaaaaacatgttgtttcatttaaattatgttgacaggtgaaattgtgaatactaaataaaatcttcagtttaatttgtaagaatgtatgtttgtatttctaggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85094 - DNA, 3992 bp, Homo sapiens
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85095 - DNA, 4740 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaacatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85096 - DNA, 3654 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacagtgcaggtatgaacaacagtgcaggtatgaacaacagtgcaggtatgtacaacagtgcaggtatgaacaacagtgcacggtatgactaccgg

SEQ ID NO: 85097 - DNA, 3224 bp, Homo sapiens
  misc_feature (3221)..(3221): n is a, c, g, or t
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttatcatcataagacaaaccataggtttattcttcacgaacatcagttaactgacctcgctcattgngtt

SEQ ID NO: 85098 - DNA, 2878 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaataggcaggcaacaccaggagcagaaatgaaagaggcaagaaagaagtgctatgtggcgagaaaaaaagttttaatgtattggagaagttttaaaaaacccagaaaaacgc

SEQ ID NO: 85099 - DNA, 2181 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaagctcatcttcagattcaagaagcatattaggttcctgctctgtctggtcatcctttgtgtctttctcaccatcttcaccggacttct

SEQ ID NO: 85100 - DNA, 3009 bp, Homo sapiens
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcagcttttattgaaatggtcgccaatccgcggattggcgaccatttcaaggggcttacctggaaatctacaagaaccccaagtataagaaactcatagatgccattgatagaaaagatcatcattgctgaagtcgtgtacaaaattaaccgtgctaatgggtaagagtacatctcggattttcctcttaacatacaataatctccttcttgctgaccataagtctggacatatcaagtcagaggttccactggtggatgtgatccataggtatcaatgagctcacagtatgatgg

SEQ ID NO: 85101 - DNA, 2380 bp, Homo sapiens
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggatgtttcaaacgggggataaaccgcgaggggatcctcgcagagtcggactggaga

SEQ ID NO: 85102 - DNA, 748 bp, Homo sapiens
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttcccccaaaatggaggatttcgcagactctgaagagcctgcttgtttgagcagcgtttctttcttttcccggtgtctcggccttcacgccgctccttgcccatcgcctcagagcgccccctaagactcccggccca

SEQ ID NO: 85103 - DNA, 1640 bp, Homo sapiens
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctaggtgtttatcctgctctgtggccctgttctgtggaatattcctattggatcagttacagttttttagccagatatttctagaacggttatggtggttctgaaatggctagtctttcgggcgcgctggaataatgtgaagaatcgttgatttcgtaggtaggggtcacgagattttgtattggtactgcgttctgtgttttaaaccttggcttaagatttctgaatagtcggtaaaatacatttttctcccagggaaatctaaacagttgactatgcggacaaaaatgatgtttcaggctattttaataaatgtttaaaatttccctttaaaaacatttctttactaatggctcagtcatctacgcagtctatcgacgtttttcacagtattgttttaaaaatcaagaaaggcttgacattttcgttgcaaaaacgctctggatgatgccttttccacttaaatagaatgtttttgcaaactcgaaattaaacaacattaaaatactgcatgaagtttcttggttatgtaagatttggaaaagatcatttagccagatgtgtgttgaagtgctttaaatttgtatttcttcctttgcacttaacagtatatacttagaacattactttgtactttacccagagaagtttcgctttatcatctttatatatttttcagccgtgtacagcttttatatcacattttg

SEQ ID NO: 85104 - DNA, 381 bp, Homo sapiens
cagcagttctctccacttttaatgtgctccaaagggagaggtcttaagaaagaatagcagtctgcacttatcaaactcagccacaatctcagtctgagttggtaaaaccgaaatggctcctaaggaaagaggaaaattttatgtcatgaatagtcacagtactttaaatctgaggcctcaagttctaagcatacaggttgtcttcctgactacagtagcgctatccatgtgcagagacgttcctatattgctacttgaaaatagataattcattggtattcctgtattcaatatcccaaaaggcatcaatggtgtaatcatgtgcatttaaataatttgatgggatttcctacttgataaataaagttactcacctactta

SEQ ID NO: 85105 - DNA, 557 bp, Homo sapiens
ttctcatctctaaaaattagggttaattataacatttgaaatacccattttataccttttaccattttttccccgtgccttattgtaatgtcctgaaagtttttgtgtgctaatgaggattaactaattgttgaaaatattgacaaaattatagtttaagtccctaaacttggatataggatatttgattttggaattaatccattttgctgcatttctcttaggtgacttaatggctgtaattctctttctttatagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgact

SEQ ID NO: 85106 - DNA, 590 bp, Homo sapiens
gtcacaactcaactgtgctcttggtattaatattggagaaggaaaatctgtgctctgttcttgtttctatgtaacccacatttctaattctttgtgcggcacttcctccttacaatttaacaaatagaggaaaaacttaatttcaacattatctgcatttgcaagcaatacaaaacaagtttattctcgtggattattttgaagttctgaaatttttcttttgaaatatctattggaaatgctttaaaactatgtttctaacacttagactctcagataactttactaataaatgatctctattttagaggccaaacaaggctgttttgtgaaaaggacagttttattttaaagttaattttctggtctttttaaagctacccagaatggaatcctgacaatgatacaggacacacaatgtaagttaaattttttaagctaccatttgtaaaggagatcaatgtaaggaattcaggtttcactttcaacatttcataaacaaagtattttcagaatttctttactgaaaatgagactttgataaaattcactttggttaacaatttttagaatatatattatgtagtaat

SEQ ID NO: 85107 - DNA, 426 bp, Homo sapiens
acacacaatgcattgctatttattatattctgtgtactagatcactaagtttgcttgtcttcctttttaggatgacttgaaagtagggcatccttcacccatctgaagggaggaaatagtggcaggtgacagtctgcatgtgcagttttcaggtaaatatccctattcattccaacattgactacctcctctgtgccaggcctgtgggctagttggtatctatcaggaaacaaatgggaggtaaattaacctgtatttgtaagatccatgaaggaaaggacaatatatcttgttttattcactgctagatcccaatcgcagtgcttggcacatggcaggacctccctgaatgttgcataaaacaactgaaaacacagaaggggattcctgttaaagggtttgacaacagggtctgcaattagtgct

SEQ ID NO: 85108 - DNA, 728 bp, Homo sapiens
  misc_feature (17)..(17): n is a, c, g, or t
cctagtcaggctcggtncctgatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatgtaggagtttgaaatacctttaaaacatccttatcgtgaatcagaatcagccattattggtttttgggagttcatcatttacttgtaatatccacaatgttaatatcacatagtggtactgtatggacaatactatttacaagtaaaatgtttagatctggaaatttcatattgaatattagatgcagtaataatattttgttatttaacatttctaggatacatatatattggtcattatacaaattggtgatttttactagacatagtgaaagatagtatttgatatgtagagtggattaaacagtagcatttttaataatacatgctctaaaaatgtaaaagatacggaaaagagggtaggttattaaaagattctaattcattg

SEQ ID NO: 85109 - DNA, 5001 bp, Homo sapiens
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85110 - DNA, 4892 bp, Homo sapiens
  misc_feature (4807)..(4807): n is a, c, g, or t
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatggggaaaaaagaacacaacatatatgctctncgaaaaatacttcggggggggtcgggacccaattccgcctatgtggagtgtttacaattacatggccggggtttaacaactcggg

SEQ ID NO: 85111 - DNA, 3911 bp, Homo sapiens
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85112 - DNA, 5465 bp, Homo sapiens
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85113 - DNA, 4715 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85114 - DNA, 3705 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcgaacctcgaggggatactctaga

SEQ ID NO: 85115 - DNA, 4605 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttataccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85116 - DNA, 4158 bp, Homo sapiens
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgttaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatgg

SEQ ID NO: 85117 - DNA, 2416 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggcggtaccagctgatagatctttgatgtaaagagtgcgggccatgcatgagcatgacgctagataaagctctacgaa

SEQ ID NO: 85118 - DNA, 2963 bp, Homo sapiens
  misc_feature (2862)..(2862): n is a, c, g, or t
  misc_feature (2932)..(2932): n is a, c, g, or t
  misc_feature (2938)..(2938): n is a, c, g, or t
aggctagtagggccgtggtaaatcggccgaggtcggtccgctgagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgagggatccaaacagangccatgattactgaaaaaagataattcccggatcttactctccagaggcaagaatctccagtggtaagtnccctgnggttcccgagactggggttcaccgg

SEQ ID NO: 85119 - DNA, 1622 bp, Homo sapiens
aggctagtagggccgtggtaaatcggccgaggtcggtccgctgagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatgtaggagtttgaaatacctttaaaacatccttatcgtgaatcagaatcagccattattggtttttgggagttcatcatttacttgtaatatccacaatgttaatatcacatagtggtactgtatggacaatactatttacaagtaaaatgtttagatctggaaatttcatattgaatattagatgcagtaataatattttgttatttaacatttctaggatacatatatattggtcattatacaaattggtgatttttactagacatagtgaaagatagtatttgatatgtagagtggattaaacagtagcatttttaataatacatgctctaaaaatgtaaaagatacggaaaagagggtaggttattaaaagattctaattcattg

SEQ ID NO: 85120 - DNA, 817 bp, Homo sapiens
ctcggcgggagtgattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagggagagacatgaagacagaggagaaatgaatgcataaaataactgataatatgaatctatacatagaacttaggaagtctcatctgcctgaaaatgactgtgtggatcccacccaaatccaactcatcctggtttgctgcacactggttcatcaaaagaaggttaccgaggggaaggaactaaaggtgtttgcacttcatgttactttttgagtttataaacataaaaacagaatttacttctgttacagacctagttactgggaattcattacttgccatggactacctttgctaagaaaagtctgaatgagaagatggcaggacgtctgaaaaaaaaagttataattaataaaatctgcggag
